United States Patent 11,920,167 (ENGINEERED GLYCOSYLTRANSFERASES AND STEVIOL GLYCOSIDE GLUCOSYLATION METHODS) - sequence listing, part 4

SEQ ID NO: 6043 - DNA, 1371 bp, Artificial Sequence
  "Variant of ADP-beta-1,3-glucosyltransferase"
atgccaaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggctggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggaggacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6044 - protein, 457 aa, Artificial Sequence
  "Variant of ADP-beta-1,3-glucosyltransferase"
MPNKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWLVRPGFVKGSEWVEPLPDGFLGERGRIVKSCPQQEVLAHKAIGAFWTHGGWNGTMEAVAEGVPMIFSDFGLDQPLNARYMSDVLHVGVYLEDGLERGEIENAIRRVMVDPEGEVMRQNAAKLKDKADRSLAPGGSSYESLESLVSYISSL

SEQ ID NO: 6045 - DNA, 1371 bp, Artificial Sequence
  "Variant of ADP-beta-1,3-glucosyltransferase"
atgccaaacaaaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggaggacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6046 - protein, 457 aa, Artificial Sequence
  "Variant of ADP-beta-1,3-glucosyltransferase"
MPNKTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLEDGLERGEIENAIRRVMVDPEGEVMRQNAAKLKDKADRSLAPGGSSYESLESLVSYISSL

SEQ ID NO: 6047 - DNA, 1371 bp, Artificial Sequence
  "Variant of ADP-beta-1,3-glucosyltransferase"
atggaaaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggctggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaacgcctggttagctatattagcagcctg

SEQ ID NO: 6048 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWLVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLERLVSYISSL

SEQ ID NO: 6049 - DNA, 1371 bp, Artificial Sequence
  "Variant of ADP-beta-1,3-glucosyltransferase"
atggaaaacacaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggctggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaacgcctggttagctatattagcagcctg

SEQ ID NO: 6050 - protein, 457 aa, Artificial Sequence
  "Variant of ADP-beta-1,3-glucosyltransferase"
MENTTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWLVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLERLVSYISSL

SEQ ID NO: 6051 - DNA, 1371 bp, Artificial Sequence
  "Variant of ADP-beta-1,3-glucosyltransferase"
atgccaaacacaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggctggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6052 - protein, 457 aa, Artificial Sequence
  "Variant of ADP-beta-1,3-glucosyltransferase"
MPNTTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWLVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6053 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggaggacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaacgcctggttagctatattagcagcctg

SEQ ID NO: 6054 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLEDGLERGEIVNAIRRVMVDPEGEVMRQNAAKLKDKADRSLAPGGSSYESLERLVSYISSL

SEQ ID NO: 6055 - DNA, 1371 bp, Artificial Sequence
  "Variant of ADP-beta-1,3-glucosyltransferase"
atggaaaacaaaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaatgggtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgtttgtcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6056 - protein, 457 aa, Artificial Sequence
  "Variant of ADP-beta-1,3-glucosyltransferase"
MENKTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQWVLAHKAIGAFWTHGGWNGTMEAVAEGVPMIFSDFGLDQPLNARYMSDVCHVGVYLENGLERGEIENAIRRVMVDPEGEVMRQNAAKLKDKADRSLAPGGSSYESLESLVSYISSL

SEQ ID NO: 6057 - DNA, 1371 bp, Artificial Sequence
  "Variant of ADP-beta-1,3-glucosyltransferase"
atgccaaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggctggttcgtccgggcttcgtgaagggtagcgagtgggttgagccgctgccggatggttttctgggcgaacgtggtcgtatcgtgaagtcttgcccgcaacaatgggtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6058 - protein, 457 aa, Artificial Sequence
  "Variant of ADP-beta-1,3-glucosyltransferase"
MPNKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWLVRPGFVKGSEWVEPLPDGFLGERGRIVKSCPQQWVLAHKAIGAFWTHGGWNGTMEGVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6059 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagaggctggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggaggacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6060 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLEAGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLEDGLERGEIVNAIRRVMVDPEGEVMRQNAAKLKDKADRSLAPGGSSYESLESLVSYISSL

SEQ ID NO: 6061 - DNA, 1371 bp, Artificial Sequence
  "Variant of ADP-beta-1,3-glucosyltransferase"
atggaaaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagaggctggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggaggacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6062 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLEAGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLEDGLERGEIVNAIRRVMVDPEGEVMRQNAAKLKDKADRSLAPGGSSYESLESLVSYISSL

SEQ ID NO: 6063 - DNA, 1371 bp, Artificial Sequence
  "Variant of ADP-beta-1,3-glucosyltransferase"
atggagaacaaaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaatgggtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaacgcctggttagctatattagcagcctg

SEQ ID NO: 6064 - protein, 457 aa, Artificial Sequence
  "Variant of ADP-beta-1,3-glucosyltransferase"
MENKTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQWVLAHKAIGAFWTHGGWNGTMEAVAEGVPMIFSDFGLDQPLNARYMSDVLHVGVYLENGLERGEIENAIRRVMVDPEGEVMRQNAAKLKDKADRSLAPGGSSYESLERLVSYISSL

SEQ ID NO: 6065 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaacgcctggttagctatattagcagcctg

SEQ ID NO: 6066 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIVNAIRRVMVDPEGEVMRQNAAKLKDKADRSLAPGGSSYESLERLVSYISSL

SEQ ID NO: 6067 - DNA, 1371 bp, Artificial Sequence
  "Variant of ADP-beta-1,3-glucosyltransferase"
atgccaaacacaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6068 - protein, 457 aa, Artificial Sequence
  "Variant of ADP-beta-1,3-glucosyltransferase"
MPNTTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6069 - DNA, 1371 bp, Artificial Sequence
  "Variant of ADP-beta-1,3-glucosyltransferase"
atggagaacaaaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagaggctggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaatgggtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaacgcctggttagctatattagcagcctg

SEQ ID NO: 6070 - protein, 457 aa, Artificial Sequence
  "Variant of ADP-beta-1,3-glucosyltransferase"
MENKTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLEAGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQWVLAHKAIGAFWTHGGWNGTMEAVAEGVPMIFSDFGLDQPLNARYMSDVLHVGVYLENGLERGEIENAIRRVMVDPEGEVMRQNAAKLKDKADRSLAPGGSSYESLERLVSYISSL

SEQ ID NO: 6071 - DNA, 1371 bp, Artificial Sequence
  "Variant of ADP-beta-1,3-glucosyltransferase"
atgccaaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagaggctggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6072 - protein, 457 aa, Artificial Sequence
  "Variant of ADP-beta-1,3-glucosyltransferase"
MPNKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLEAGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6073 - DNA, 1371 bp, Artificial Sequence
  "Variant of ADP-beta-1,3-glucosyltransferase"
atgccaaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6074 - protein, 457 aa, Artificial Sequence
  "Variant of ADP-beta-1,3-glucosyltransferase"
MPNKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6075 - DNA, 1371 bp, Artificial Sequence
  "Variant of ADP-beta-1,3-glucosyltransferase"
atggaaaacaaaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagaggctggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6076 - protein, 457 aa, Artificial Sequence
  "Variant of ADP-beta-1,3-glucosyltransferase"
MENKTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLEAGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6077 - DNA, 1371 bp, Artificial Sequence
  "Variant of ADP-beta-1,3-glucosyltransferase"
atgccaaacacaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggctggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6078 - protein, 457 aa, Artificial Sequence
  "Variant of ADP-beta-1,3-glucosyltransferase"
MPNTTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWLVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6079 - DNA, 1371 bp, Artificial Sequence
  "Variant of ADP-beta-1,3-glucosyltransferase"
atggaaaacacaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagaggctggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggctggttcgtccgggcttcgtgaagggtagcgagtgggttgagccgctgccggatggttttctgggcgaacgtggtcgtatcgtgaagtcttgcccgcaacaatgggtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaacgcctggttagctatattagcagcctg

SEQ ID NO: 6080 - protein, 457 aa, Artificial Sequence
  "Variant of ADP-beta-1,3-glucosyltransferase"
MENTTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLEAGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWLVRPGFVKGSEWVEPLPDGFLGERGRIVKSCPQQWVLAHKAIGAFWTHGGWNGTMEGVAEGVPMIFSDFGLDQPLNARYMSDVLHVGVYLENGLERGEIVNAIRRVMVDPEGEVMRQNAAKLKDKADRSLAPGGSSYESLERLVSYISSL

SEQ ID NO: 6081 - DNA, 1371 bp, Artificial Sequence
  "Variant of ADP-beta-1,3-glucosyltransferase"
atgccaaacaaaaccgaaaccaccgtgcgtcgtcgtcgtgttattctgtttccggttccattcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagaggctggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggctggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6082 - protein, 457 aa, Artificial Sequence
  "Variant of ADP-beta-1,3-glucosyltransferase"
MPNKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLEAGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWLVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6083 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagaggctggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggaggacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaacgcctggttagctatattagcagcctg

SEQ ID NO: 6084 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLEAGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLEDGLERGEIENAIRRVMVDPEGEVMRQNAAKLKDKADRSLAPGGSSYESLERLVSYISSL

SEQ ID NO: 6085 - DNA, 1371 bp, Artificial Sequence
  "Variant of ADP-beta-1,3-glucosyltransferase"
atggaaaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagaggctggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaatgggtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6086 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLEAGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQWVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6087 - DNA, 1371 bp, Artificial Sequence
  "Variant of ADP-beta-1,3-glucosyltransferase"
atggagaacaaaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6088 - protein, 457 aa, Artificial Sequence
  "Variant of ADP-beta-1,3-glucosyltransferase"
MENKTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6089 - DNA, 1371 bp, Artificial Sequence
  "Variant of ADP-beta-1,3-glucosyltransferase"
atggaaaacacaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggctggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6090 - protein, 457 aa, Artificial Sequence
  "Variant of ADP-beta-1,3-glucosyltransferase"
MENTTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWLVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6091 - DNA, 1371 bp, Artificial Sequence
  "Variant of ADP-beta-1,3-glucosyltransferase"
atgccaaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggctggttcgtccgggcttcgtgaagggtagcgagtgggttgagccgctgccggatggttttctgggcgaacgtggtcgtatcgtgaagtcttgcccgcaacaatgggtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6092 - protein, 457 aa, Artificial Sequence
  "Variant of ADP-beta-1,3-glucosyltransferase"
MPNKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWLVRPGFVKGSEWVEPLPDGFLGERGRIVKSCPQQWVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6093 - DNA, 1371 bp, Artificial Sequence
  "Variant of ADP-beta-1,3-glucosyltransferase"
atggaaaacacaaccgaaaccaccgtgcgtcgtcgtcgtattattctgtttccggttccattcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgtttgtcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6094 - protein, 457 aa, Artificial Sequence
  "Variant of ADP-beta-1,3-glucosyltransferase"
MENTTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVCHVGVYLENGLERGEIVNAIRRVMVDPEGEVMRQNAAKLKDKADRSLAPGGSSYESLESLVSYISSL

SEQ ID NO: 6095 - DNA, 1371 bp, Artificial Sequence
  "Variant of ADP-beta-1,3-glucosyltransferase"
atggaaaacacaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgtttgtcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6096 - protein, 457 aa, Artificial Sequence
  "Variant of ADP-beta-1,3-glucosyltransferase"
MENTTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVCHVGVYLENGLERGEIENAIRRVMVDPEGEVMRQNAAKLKDKADRSLAPGGSSYESLESLVSYISSL

SEQ ID NO: 6097 - DNA, 1371 bp, Artificial Sequence
  "Variant of ADP-beta-1,3-glucosyltransferase"
atggaaaacacaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagaggctggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6098 - protein, 457 aa, Artificial Sequence
  "Variant of ADP-beta-1,3-glucosyltransferase"
MENTTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLEAGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6099 - DNA, 1371 bp, Artificial Sequence
  "Variant of ADP-beta-1,3-glucosyltransferase"
atgccaaacacaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagaggctggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggaggacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6100 - protein, 457 aa, Artificial Sequence
  "Variant of ADP-beta-1,3-glucosyltransferase"
MPNTTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLEAGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLEDGLERGEIENAIRRVMVDPEGEVMRQNAAKLKDKADRSLAPGGSSYESLESLVSYISSL

SEQ ID NO: 6101 - DNA, 1371 bp, Artificial Sequence
  "Variant of ADP-beta-1,3-glucosyltransferase"
atggaaaacaaaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6102 - protein, 457 aa, Artificial Sequence
  "Variant of ADP-beta-1,3-glucosyltransferase"
MENKTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6103 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagaggctggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggctggttcgtccgggcttcgtgaagggtagcgagtgggttgagccgctgccggatggttttctgggcgaacgtggtcgtatcgtgaagtcttgcccgcaacaatgggtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6104 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLEAGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWLVRPGFVKGSEWVEPLPDGFLGERGRIVKSCPQQWVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6105 - DNA, 1371 bp, Artificial Sequence
  "Variant of ADP-beta-1,3-glucosyltransferase"
atggaaaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagaggctggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaacgcctggttagctatattagcagcctg

SEQ ID NO: 6106 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLEAGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIVNAIRRVMVDPEGEVMRQNAAKLKDKADRSLAPGGSSYESLERLVSYISSL

SEQ ID NO: 6107 - DNA, 1371 bp, Artificial Sequence
  "Variant of ADP-beta-1,3-glucosyltransferase"
atgccaaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagaggctggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaacgcctggttagctatattagcagcctg

SEQ ID NO: 6108 - protein, 457 aa, Artificial Sequence
  "Variant of ADP-beta-1,3-glucosyltransferase"
MPNKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLEAGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIVNAIRRVMVDPEGEVMRQNAAKLKDKADRSLAPGGSSYESLERLVSYISSL

SEQ ID NO: 6109 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgtttgtcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaacgcctggttagctatattagcagcctg

SEQ ID NO: 6110 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVCHVGVYLENGLERGEIENAIRRVMVDPEGEVMRQNAAKLKDKADRSLAPGGSSYESLERLVSYISSL

SEQ ID NO: 6111 - DNA, 1371 bp, Artificial Sequence
  "Variant of ADP-beta-1,3-glucosyltransferase"
atggagaacaaaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6112 - protein, 457 aa, Artificial Sequence
  "Variant of ADP-beta-1,3-glucosyltransferase"
MENKTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6113 - DNA, 1371 bp, Artificial Sequence
  "Variant of ADP-beta-1,3-glucosyltransferase"
atggagaacaaaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagaggctggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggctggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6114 - protein, 457 aa, Artificial Sequence
  "Variant of ADP-beta-1,3-glucosyltransferase"
MENKTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLEAGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWLVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6115 - DNA, 1371 bp, Artificial Sequence
  "Variant of ADP-beta-1,3-glucosyltransferase"
atgccaaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggctggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6116 - protein, 457 aa, Artificial Sequence
  "Variant of ADP-beta-1,3-glucosyltransferase"
MPNKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWLVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6117 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagaggctggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaatgggtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6118 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLEAGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQWVLAHKAIGAFWTHGGWNGTMEAVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6119 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggctggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6120 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWLVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6121 - DNA, 1371 bp, Artificial Sequence
  "Variant of ADP-beta-1,3-glucosyltransferase"
atgccaaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggctggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgtttgtcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6122 - protein, 457 aa, Artificial Sequence
  "Variant of ADP-beta-1,3-glucosyltransferase"
MPNKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWLVRPGFVKGSEWVEPLPDGFLGERGRIVKSCPQQEVLAHKAIGAFWTHGGWNGTMEGVAEGVPMIFSDFGLDQPLNARYMSDVCHVGVYLENGLERGEIVNAIRRVMVDPEGEVMRQNAAKLKDKADRSLAPGGSSYESLESLVSYISSL

SEQ ID NO: 6123 - DNA, 1371 bp, Artificial Sequence
  "Variant of ADP-beta-1,3-glucosyltransferase"
atggaaaacacaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6124 - protein, 457 aa, Artificial Sequence
  "Variant of ADP-beta-1,3-glucosyltransferase"
MENTTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6125 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaacgcctggttagctatattagcagcctg

SEQ ID NO: 6126 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLERLVSYISSL

SEQ ID NO: 6127 - DNA, 1371 bp, Artificial Sequence
  "Variant of ADP-beta-1,3-glucosyltransferase"
atgccaaacacaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6128 - protein, 457 aa, Artificial Sequence
  "Variant of ADP-beta-1,3-glucosyltransferase"
MPNTTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6129 - DNA, 1371 bp, Artificial Sequence
  "Variant of ADP-beta-1,3-glucosyltransferase"
atgccaaacaaaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6130 - protein, 457 aa, Artificial Sequence
  "Variant of ADP-beta-1,3-glucosyltransferase"
MPNKTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6131 - DNA, 1371 bp, Artificial Sequence
  "Variant of ADP-beta-1,3-glucosyltransferase"
atgccaaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggaggacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6132 - protein, 457 aa, Artificial Sequence
  "Variant of ADP-beta-1,3-glucosyltransferase"
MPNKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLEDGLERGEIVNAIRRVMVDPEGEVMRQNAAKLKDKADRSLAPGGSSYESLESLVSYISSL

SEQ ID NO: 6133 - DNA, 1371 bp, Artificial Sequence
  "Variant of ADP-beta-1,3-glucosyltransferase"
atggaaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6134 - protein, 457 aa, Artificial Sequence
  "Variant of ADP-beta-1,3-glucosyltransferase"
MENTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6135 - DNA, 1371 bp, Artificial Sequence
  "Variant of ADP-beta-1,3-glucosyltransferase"
atggaaaacacaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagaggctggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6136 - protein, 457 aa, Artificial Sequence
  "Variant of ADP-beta-1,3-glucosyltransferase"
MENTTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLEAGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6137 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6138 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6139 - DNA, 1371 bp, Artificial Sequence
  "Variant of ADP-beta-1,3-glucosyltransferase"
atgccaaacaaaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagaggctggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6140 - protein, 457 aa, Artificial Sequence
  "Variant of ADP-beta-1,3-glucosyltransferase"
MPNKTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLEAGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6141 - DNA, 1371 bp, Artificial Sequence
  "Variant of ADP-beta-1,3-glucosyltransferase"
atggaaaacaaaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggaggacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaacgcctggttagctatattagcagcctg

SEQ ID NO: 6142 - protein, 457 aa, Artificial Sequence
  "Variant of ADP-beta-1,3-glucosyltransferase"
MENKTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLEDGLERGEIVNAIRRVMVDPEGEVMRQNAAKLKDKADRSLAPGGSSYESLERLVSYISSL

SEQ ID NO: 6143 - DNA, 1371 bp, Artificial Sequence
  "Variant of ADP-beta-1,3-glucosyltransferase"
atggaaaacacaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaatgggtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggaggacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6144 - protein, 457 aa, Artificial Sequence
  "Variant of ADP-beta-1,3-glucosyltransferase"
MENTTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQWVLAHKAIGAFWTHGGWNGTMEGVAEGVPMIFSDFGLDQPLNARYMSDVLHVGVYLEDGLERGEIVNAIRRVMVDPEGEVMRQNAAKLKDKADRSLAPGGSSYESLESLVSYISSL

SEQ ID NO: 6145 - DNA, 1371 bp, Artificial Sequence
  "Variant of ADP-beta-1,3-glucosyltransferase"
atgccaaacaaaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggctggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6146 - protein, 457 aa, Artificial Sequence
  "Variant of ADP-beta-1,3-glucosyltransferase"
MPNKTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWLVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6147 - DNA, 1371 bp, Artificial Sequence
  "Variant of ADP-beta-1,3-glucosyltransferase"
atgccaaacacaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaacgcctggttagctatattagcagcctg

SEQ ID NO: 6148 - protein, 457 aa, Artificial Sequence
  "Variant of ADP-beta-1,3-glucosyltransferase"
MPNTTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIENAIRRVMVDPEGEVMRQNAAKLKDKADRSLAPGGSSYESLERLVSYISSL

SEQ ID NO: 6149 - DNA, 1371 bp, Artificial Sequence
  "Variant of ADP-beta-1,3-glucosyltransferase"
atgccaaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggaggacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6150 - protein, 457 aa, Artificial Sequence
  "Variant of ADP-beta-1,3-glucosyltransferase"
MPNKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLEDGLERGEIENAIRRVMVDPEGEVMRQNAAKLKDKADRSLAPGGSSYESLESLVSYISSL

SEQ ID NO: 6151 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaacgcctggttagctatattagcagcctg

SEQ ID NO: 6152 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIENAIRRVMVDPEGEVMRQNAAKLKDKADRSLAPGGSSYESLERLVSYISSL

SEQ ID NO: 6153 - DNA, 1371 bp, Artificial Sequence
  "Variant of ADP-beta-1,3-glucosyltransferase"
atgccaaacacaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagaggctggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6154 - protein, 457 aa, Artificial Sequence
  "Variant of ADP-beta-1,3-glucosyltransferase"
MPNTTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLEAGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6155 - DNA, 1371 bp, Artificial Sequence
  "Variant of ADP-beta-1,3-glucosyltransferase"
atggaaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaatgggtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6156 - protein, 457 aa, Artificial Sequence
  "Variant of ADP-beta-1,3-glucosyltransferase"
MENTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQWVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6157 - DNA, 1371 bp, Artificial Sequence
  "Variant of ADP-beta-1,3-glucosyltransferase"
atggaaaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagaggctggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggctggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggaggacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6158 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLEAGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWLVRPGFVKGSEWVEPLPDGFLGERGRIVKSCPQQEVLAHKAIGAFWTHGGWNGTMEAVAEGVPMIFSDFGLDQPLNARYMSDVLHVGVYLEDGLERGEIENAIRRVMVDPEGEVMRQNAAKLKDKADRSLAPGGSSYESLESLVSYISSL

SEQ ID NO: 6159 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggctggttcgtccgggcttcgtgaagggtagcgagtgggttgagccgctgccggatggttttctgggcgaacgtggtcgtatcgtgaagtcttgcccgcaacaatgggtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6160 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWLVRPGFVKGSEWVEPLPDGFLGERGRIVKSCPQQWVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6161 - DNA, 1371 bp, Artificial Sequence
  "Variant of ADP-beta-1,3-glucosyltransferase"
atggagaacaaaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6162 - protein, 457 aa, Artificial Sequence
  "Variant of ADP-beta-1,3-glucosyltransferase"
MENKTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6163 - DNA, 1371 bp, Artificial Sequence
  "Variant of ADP-beta-1,3-glucosyltransferase"
atggaaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6164 - protein, 457 aa, Artificial Sequence
  "Variant of ADP-beta-1,3-glucosyltransferase"
MENTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6165 - DNA, 1371 bp, Artificial Sequence
  "Variant of ADP-beta-1,3-glucosyltransferase"
atggagaacaaaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggctggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6166 - protein, 457 aa, Artificial Sequence
  "Variant of ADP-beta-1,3-glucosyltransferase"
MENKTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWLVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6167 - DNA, 1371 bp, Artificial Sequence
  "Variant of ADP-beta-1,3-glucosyltransferase"
atggagaacaaaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgtttgtcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaacgcctggttagctatattagcagcctg

SEQ ID NO: 6168 - protein, 457 aa, Artificial Sequence
  "Variant of ADP-beta-1,3-glucosyltransferase"
MENKTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVCHVGVYLENGLERGEIVNAIRRVMVDPEGEVMRQNAAKLKDKADRSLAPGGSSYESLERLVSYISSL

SEQ ID NO: 6169 - DNA, 1371 bp, Artificial Sequence
  "Variant of ADP-beta-1,3-glucosyltransferase"
atggaaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggaggacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6170 - protein, 457 aa, Artificial Sequence
  "Variant of ADP-beta-1,3-glucosyltransferase"
MENTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLEDGLERGEIENAIRRVMVDPEGEVMRQNAAKLKDKADRSLAPGGSSYESLESLVSYISSL

SEQ ID NO: 6171 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggggtcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6172 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWGRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6173 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgagtcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6174 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLSRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6175 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggctttctgcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6176 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGFLRGEIENAIRRVMVDPEGEVMRQNAAKLKDKADRSLAPGGSSYESLESLVSYISSL

SEQ ID NO: 6177 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaagtggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6178 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQVVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6179 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatgtgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6180 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNVPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6181 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcagtatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6182 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRISIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6183 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagccagagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6184 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSQSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6185 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgcgtcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6186 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLRRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6187 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgcatcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6188 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAHRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6189 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaatatgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6190 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELEYAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6191 - DNA, 1371 bp, Artificial Sequence
  "Variant of ADP-beta-1,3-glucosyltransferase"
atggagaacaaaaccgaaaccaccgtgcgtcgttcgcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6192 - protein, 457 aa, Artificial Sequence
  "Variant of ADP-beta-1,3-glucosyltransferase"
MENKTETTVRRSRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6193 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcacgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6194 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRITIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6195 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggtttcgccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6196 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVSPEGEVMRQNAAKLKDKADRSLAPGGSSYESLESLVSYISSL

SEQ ID NO: 6197 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctggctcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6198 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLARLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6199 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcgaagaaactgaaggataaagcggatcgaagcctggctcccggtggcagcagctacgagagcctggaaagcctggttagctatattagcagcctg

SEQ ID NO: 6200 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAKKLKDKADRSLAPGGSSYESLESLVSYISSL

SEQ ID NO: 6201 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccgtgtttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6202 - protein, 457 aa, Artificial Sequence
  "Variant of ADP-beta-1,3-glucosyltransferase"
MENKTETTVRRRRVILFPVPFPGHLNPMLQLANVLYSRGFSITVFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6203 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcattgcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6204 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGIAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6205 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtaccggagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6206 - protein, 457 aa, Artificial Sequence
  "Variant of ADP-beta-1,3-glucosyltransferase"
MENKTETTVRRRRVILFPVPFPGHLNPMLQLANVLYRRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6207 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgtgtcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6208 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPCHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6209 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctgaatgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6210 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLNEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6211 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagaccgtgaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6212 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDREVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6213 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgctggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaaaagggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6214 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPLDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGEKGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6215 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggatgcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6216 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWMRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6217 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttctgccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6218 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVLPEGEVMRQNAAKLKDKADRSLAPGGSSYESLESLVSYISSL

SEQ ID NO: 6219 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaacctgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6220 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEPEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6221 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagctctgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6222 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSSVLHVGVYLENGLERGEIENAIRRVMVDPEGEVMRQNAAKLKDKADRSLAPGGSSYESLESLVSYISSL

SEQ ID NO: 6223 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagccggctg

SEQ ID NO: 6224 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISRL

SEQ ID NO: 6225 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagctagctg

SEQ ID NO: 6226 - protein, 455 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYIS

SEQ ID NO: 6227 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtgtctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6228 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVCLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6229 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgataagcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6230 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDKQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6231 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgctgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6232 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSAVLHVGVYLENGLERGEIENAIRRVMVDPEGEVMRQNAAKLKDKADRSLAPGGSSYESLESLVSYISSL

SEQ ID NO: 6233 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagtggtatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6234 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKWYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6235 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcgcgtaaactgaaggataaagcggatcgaagcctggctcccggtggcagcagctacgagagcctggaaagcctggttagctatattagcagcctg

SEQ ID NO: 6236 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNARKLKDKADRSLAPGGSSYESLESLVSYISSL

SEQ ID NO: 6237 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaatggaaggataaagcggatcgaagcctggctcccggtggcagcagctacgagagcctggaaagcctggttagctatattagcagcctg

SEQ ID NO: 6238 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKWKDKADRSLAPGGSSYESLESLVSYISSL

SEQ ID NO: 6239 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgctgcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6240 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPLHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6241 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaactggatcgaagcctggctcccggtggcagcagctacgagagcctggaaagcctggttagctatattagcagcctg

SEQ ID NO: 6242 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKLDRSLAPGGSSYESLESLVSYISSL

SEQ ID NO: 6243 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagcgcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgcgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6244 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLALGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6245 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagttgtatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6246 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKLYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6247 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggatcttgcggatcgaagcctggctcccggtggcagcagctacgagagcctggaaagcctggttagctatattagcagcctg

SEQ ID NO: 6248 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDLADRSLAPGGSSYESLESLVSYISSL

SEQ ID NO: 6249 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagtgttatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6250 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKCYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6251 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtcctgaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6252 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRPEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6253 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcaatgaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6254 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSNEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6255 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgaggttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6256 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSEVLHVGVYLENGLERGEIENAIRRVMVDPEGEVMRQNAAKLKDKADRSLAPGGSSYESLESLVSYISSL

SEQ ID NO: 6257 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatccagatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6258 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEWLRNLPTHGPGAGMRIQIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6259 - DNA, 1371 bp, Artificial Sequence
  "Variant of ADP-beta-1,3-glucosyltransferase"
atggagaacaaaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagcatcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggatgctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcacccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggagggcgtggcggaaggcgttccgatgatctttagcgatttcggtctggatcagccgctgaacgcgcgttacatgagcgatgttctgcatgtgggcgtttatctggagaacggcttggagcgtggtgaaatcgaaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6260 - protein, 457 aa, Artificial Sequence
  "Variant of ADP-beta-1,3-glucosyltransferase"
MENKTETTVRRRRVILFPVPFPGHLNPMLQLANVLYSRGFSITIFHTNFNAPKTSLYPHFSFRFILDNDPQDEHLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQDAKPILDKMIEETRASSGVIWNSFKELEESELETVWREIPAPSFLLPLPKHYRASSSSLLDEDPSVAQWLDQQPPSSVLYVGFGTQSEVDEKDFLEIARGLVDSKQSFLWRVRPGFVKGSEWVEPLPDGFLGERGRIVKSCPQQEVLAHKAIGAFWTHGGWNGTMEGVAEGVPMIFSDFGLDQPLNARYMSDVLHVGVYLENGLERGEIENAIRRVMVDPEGEVMRQNAAKLKDKADRSLAPGGSSYESLESLVSYISSL

SEQ ID NO: 6261 - DNA, 1371 bp, Artificial Sequence
  "Variant of ADP-beta-1,3-glucosyltransferase"
atgccaaacacaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgatcgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagccttgctcccggtggcagcagctacgagagcctggaaagcctggttagctatattagcagcctg

SEQ ID NO: 6262 - protein, 457 aa, Artificial Sequence
  "Variant of ADP-beta-1,3-glucosyltransferase"
MPNTTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGDRGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6263 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagaggctggctacctggatccggaagataaacatcgtctggaggaaccggtggtaggtttcccgatgctgaaggttaaagatatcagacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgcaggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaaagcctggttagctatattagcagcctg

SEQ ID NO: 6264 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLEAGYLDPEDKHRLEEPVVGFPMLKVKDIRRAYSHWQEAKPILDKMIEETRASSGVIWNSFKELEESELETVWREIPAPSFLLPLPKHYRASSSSLQDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLESLVSYISSL

SEQ ID NO: 6265 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaggacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaacgcctggttagctatattagcagcctg

SEQ ID NO: 6266 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLERLVSYISSL

SEQ ID NO: 6267 - DNA, 1371 bp, Artificial Sequence
  "Variant of ADP-beta-1,3-glucosyltransferase"
atgccaaacacaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaggacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagaggctggctacctggatccggaagataaacatcgtctggaggaaccggtggtaggtttcccgatgctgaaggttaaagatatcagacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaatgggtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaaagcctggttagctatattagcagcctg

SEQ ID NO: 6268 - protein, 457 aa, Artificial Sequence
  "Variant of ADP-beta-1,3-glucosyltransferase"
MPNTTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLEAGYLDPEDKHRLEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQWVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLESLVSYISSL

SEQ ID NO: 6269 - DNA, 1371 bp, Artificial Sequence
  "Variant of ADP-beta-1,3-glucosyltransferase"
atgccaaacacaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaggacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcagacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgcaggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtcgcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6270 - protein, 457 aa, Artificial Sequence
  "Variant of ADP-beta-1,3-glucosyltransferase"
MPNTTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIRRAYSHWQEAKPILDKMIEETRASSGVIWNSFKELEESELETVWREIPAPSFLLPLPKHYRASSSSLQDEDPSVAQWLDQQPPSSVLYVGFGSQSEVDEKDFLEIARGLVDSKQSFLWRVRPGFVKGREWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6271 - DNA, 1371 bp, Artificial Sequence
  "Variant of ADP-beta-1,3-glucosyltransferase"
atgccaaacacaaccgaaaccaccgtgcgtcgtcgtcgtattattctgtttccggttccattcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagaggctggctacctggatccggaagataaacatcgtctggaggaaccggtggtaggtttcccgatgctgaaggttaaagatatcagacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgcaggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggctggttcgtccgggcttcgtgaagggtagcgagtgggttgagccgctgccggatggttttctgggcgaacgtggtcgtatcgtgaagtcttgcccgcaacaatgggtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagccttgctcccggtggcagcagctacgagagcctggaaagcctggttagctatattagcagcctg

SEQ ID NO: 6272 - protein, 457 aa, Artificial Sequence
  "Variant of ADP-beta-1,3-glucosyltransferase"
MPNTTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLEAGYLDPEDKHRLEEPVVGFPMLKVKDIRRAYSHWQEAKPILDKMIEETRASSGVIWNSFKELEESELETVWREIPAPSFLLPLPKHYRASSSSLQDEDPSVAQWLDQQPPSSVLYVGFGSQSEVDEKDFLEIARGLVDSKQSFLWLVRPGFVKGSEWVEPLPDGFLGERGRIVKSCPQQWVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6273 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagaggctggctacctggatccggaagataaacatcgtctggaggaaccggtggtaggtttcccgatgctgaaggttaaagatatcagacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggctggttcgtccgggcttcgtgaagggtagcgagtggattgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagccttgctcccggtggcagcagctacgagagcctggaaagcctggttagctatattagcagcctg

SEQ ID NO: 6274 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLEAGYLDPEDKHRLEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWLVRPGFVKGSEWIEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6275 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaggacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcagacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaacgcctggttagctatattagcagcctg

SEQ ID NO: 6276 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLERLVSYISSL

SEQ ID NO: 6277 - DNA, 1371 bp, Artificial Sequence
  "Variant of ADP-beta-1,3-glucosyltransferase"
atgccaaacacaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagaggctggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagccttgctcccggtggcagcagctacgagagcctggaaagcctggttagctatattagcagcctg

SEQ ID NO: 6278 - protein, 457 aa, Artificial Sequence
  "Variant of ADP-beta-1,3-glucosyltransferase"
MPNTTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLEAGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6279 - DNA, 1371 bp, Artificial Sequence
  "Variant of ADP-beta-1,3-glucosyltransferase"
atgccaaacacaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagaggctggctacctggatccggaagataaacatcgtctggaggaaccggtggtaggtttcccgatgctgaaggttaaagatatcagacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggctggttcgtccgggcttcgtgaagggtcgcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagccttgctcccggtggcagcagctacgagagcctggaaagcctggttagctatattagcagcctg

SEQ ID NO: 6280 - protein, 457 aa, Artificial Sequence
  "Variant of ADP-beta-1,3-glucosyltransferase"
MPNTTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLDQFLEAGYLDPEDKHRLEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWLVRPGFVKGREWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6281 - DNA, 1371 bp, Artificial Sequence
  "Variant of ADP-beta-1,3-glucosyltransferase"
atgccaaacacaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6282 - protein, 457 aa, Artificial Sequence
  "Variant of ADP-beta-1,3-glucosyltransferase"
MPNTTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6283 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcagacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaacgcctggttagctatattagcagcctg

SEQ ID NO: 6284 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLERLVSYISSL

SEQ ID NO: 6285 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgcaggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtcgcgagtgggttgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaaagcctggttagctatattagcagcctg

SEQ ID NO: 6286 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLQDEDPSVAQWLDQQPPSSVLYVGFGSQSEVDEKDFLEIARGLVDSKQSFLWRVRPGFVKGREWVELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLESLVSYISSL

SEQ ID NO: 6287 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaaagcctggttagctatattagcagcctg

SEQ ID NO: 6288 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLESLVSYISSL

SEQ ID NO: 6289 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcagacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgcaggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6290 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIRRAYSHWQEAKPILDKMIEETRASSGVIWNSFKELEESELETVWREIPAPSFLLPLPKHYRASSSSLQDEDPSVAQWLDQQPPSSVLYVGFGSQSEVDEKDFLEIARGLVDSKQSFLWRVRPGFVKGSEWIEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6291 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaggacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagctgctgccggatggttttctgggcgatcgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6292 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVELLPDGFLGDRGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6293 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaggacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtcgcgagtggattgagctgctgccggatggttttctgggcgatcgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagccttgctcccggtggcagcagctacgagagcctggaaagcctggttagctatattagcagcctg

SEQ ID NO: 6294 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGREWIELLPDGFLGDRGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6295 - DNA, 1371 bp, Artificial Sequence
  "Variant of ADP-beta-1,3-glucosyltransferase"
atgccaaacacaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaggacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaacgcctggttagctatattagcagcctg

SEQ ID NO: 6296 - protein, 457 aa, Artificial Sequence
  "Variant of ADP-beta-1,3-glucosyltransferase"
MPNTTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLERLVSYISSL

SEQ ID NO: 6297 - DNA, 1371 bp, Artificial Sequence
  "Variant of ADP-beta-1,3-glucosyltransferase"
atgccaaacacaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggctggttcgtccgggcttcgtgaagggtcgcgagtgggttgagccgctgccggatggttttctgggcgatcgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagccttgctcccggtggcagcagctacgagagcctggaacgcctggttagctatattagcagcctg

SEQ ID NO: 6298 - protein, 457 aa, Artificial Sequence
  "Variant of ADP-beta-1,3-glucosyltransferase"
MPNTTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWLVRPGFVKGREWVEPLPDGFLGDRGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLERLVSYISSL

SEQ ID NO: 6299 - DNA, 1371 bp, Artificial Sequence
  "Variant of ADP-beta-1,3-glucosyltransferase"
atgccaaacacaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagaggctggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaaagcctggttagctatattagcagcctg

SEQ ID NO: 6300 - protein, 457 aa, Artificial Sequence
  "Variant of ADP-beta-1,3-glucosyltransferase"
MPNTTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLEAGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLESLVSYISSL

SEQ ID NO: 6301 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaggacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggctggttcgtccgggcttcgtgaagggtagcgagtggattgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaaagcctggttagctatattagcagcctg

SEQ ID NO: 6302 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWLVRPGFVKGSEWIEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLESLVSYISSL

SEQ ID NO: 6303 - DNA, 1371 bp, Artificial Sequence
  "Variant of ADP-beta-1,3-glucosyltransferase"
atgccaaacacaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaggacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagaggctggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgcaggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggctggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaacgcctggttagctatattagcagcctg

SEQ ID NO: 6304 - protein, 457 aa, Artificial Sequence
  "Variant of ADP-beta-1,3-glucosyltransferase"
MPNTTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLEAGYLDPEDKHRLEEPVVGFPMLKVKDIKRAYSHWQEAKPILDKMIEETRASSGVIWNSFKELEESELETVWREIPAPSFLLPLPKHYRASSSSLQDEDPSVAQWLDQQPPSSVLYVGFGSQSEVDEKDFLEIARGLVDSKQSFLWLVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLERLVSYISSL

SEQ ID NO: 6305 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaggacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagaggctggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggctggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6306 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLEAGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWLVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6307 - DNA, 1371 bp, Artificial Sequence
  "Variant of ADP-beta-1,3-glucosyltransferase"
atgccaaacacaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaggacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgcaggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggctggttcgtccgggcttcgtgaagggtagcgagtggattgagctgctgccggatggttttctgggcgatcgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6308 - protein, 457 aa, Artificial Sequence
  "Variant of ADP-beta-1,3-glucosyltransferase"
MPNTTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLQDEDPSVAQWLDQQPPSSVLYVGFGSQSEVDEKDFLEIARGLVDSKQSFLWLVRPGFVKGSEWIELLPDGFLGDRGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6309 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagaggctggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgcaggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggctggttcgtccgggcttcgtgaagggtcgcgagtgggttgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaacgcctggttagctatattagcagcctg

SEQ ID NO: 6310 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLEAGYLDPEDKHRLEEPVVGFPMLKVKDIKRAYSHWQEAKPILDKMIEETRASSGVIWNSFKELEESELETVWREIPAPSFLLPLPKHYRASSSSLQDEDPSVAQWLDQQPPSSVLYVGFGSQSEVDEKDFLEIARGLVDSKQSFLWLVRPGFVKGREWVELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLERLVSYISSL

SEQ ID NO: 6311 - DNA, 1371 bp, Artificial Sequence
  "Variant of ADP-beta-1,3-glucosyltransferase"
atgccaaacacaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaggacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagaggctggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtcgcgagtggattgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagccttgctcccggtggcagcagctacgagagcctggaaagcctggttagctatattagcagcctg

SEQ ID NO: 6312 - protein, 457 aa, Artificial Sequence
  "Variant of ADP-beta-1,3-glucosyltransferase"
MPNTTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLEAGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGREWIEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6313 - DNA, 1371 bp, Artificial Sequence
  "Variant of ADP-beta-1,3-glucosyltransferase"
atgccaaacacaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaggacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgcaggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggctggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaacgcctggttagctatattagcagcctg

SEQ ID NO: 6314 - protein, 457 aa, Artificial Sequence
  "Variant of ADP-beta-1,3-glucosyltransferase"
MPNTTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLQDEDPSVAQWLDQQPPSSVLYVGFGSQSEVDEKDFLEIARGLVDSKQSFLWLVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLERLVSYISSL

SEQ ID NO: 6315 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaggacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagaggctggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggctggttcgtccgggcttcgtgaagggtagcgagtgggttgagccgctgccggatggttttctgggcgatcgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaacgcctggttagctatattagcagcctg

SEQ ID NO: 6316 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLEAGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWLVRPGFVKGSEWVEPLPDGFLGDRGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLERLVSYISSL

SEQ ID NO: 6317 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagaggctggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagccttgctcccggtggcagcagctacgagagcctggaaagcctggttagctatattagcagcctg

SEQ ID NO: 6318 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLEAGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6319 - DNA, 1371 bp, Artificial Sequence
  "Variant of ADP-beta-1,3-glucosyltransferase"
atgccaaacacaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaggacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagaggctggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgcaggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagccttgctcccggtggcagcagctacgagagcctggaaagcctggttagctatattagcagcctg

SEQ ID NO: 6320 - protein, 457 aa, Artificial Sequence
  "Variant of ADP-beta-1,3-glucosyltransferase"
MPNTTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLEAGYLDPEDKHRLEEPVVGFPMLKVKDIKRAYSHWQEAKPILDKMIEETRASSGVIWNSFKELEESELETVWREIPAPSFLLPLPKHYRASSSSLQDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6321 - DNA, 1371 bp, Artificial Sequence
  "Variant of ADP-beta-1,3-glucosyltransferase"
atgccaaacacaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaggacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtcgcgagtggattgagccgctgccggatggttttctgggcgatcgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaaagcctggttagctatattagcagcctg

SEQ ID NO: 6322 - protein, 457 aa, Artificial Sequence
  "Variant of ADP-beta-1,3-glucosyltransferase"
MPNTTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGREWIEPLPDGFLGDRGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLESLVSYISSL

SEQ ID NO: 6323 - DNA, 1371 bp, Artificial Sequence
  "Variant of ADP-beta-1,3-glucosyltransferase"
atgccaaacacaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaacgcctggttagctatattagcagcctg

SEQ ID NO: 6324 - protein, 457 aa, Artificial Sequence
  "Variant of ADP-beta-1,3-glucosyltransferase"
MPNTTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLERLVSYISSL

SEQ ID NO: 6325 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgcaggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggctggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6326 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLQDEDPSVAQWLDQQPPSSVLYVGFGSQSEVDEKDFLEIARGLVDSKQSFLWLVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6327 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagaggctggctacctggatccggaagataaacatcgtctggaggaaccggtggtaggtttcccgatgctgaaggttaaagatatcagacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggctggttcgtccgggcttcgtgaagggtcgcgagtgggttgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagccttgctcccggtggcagcagctacgagagcctggaaagcctggttagctatattagcagcctg

SEQ ID NO: 6328 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLEAGYLDPEDKHRLEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWLVRPGFVKGREWVELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6329 - DNA, 1371 bp, Artificial Sequence
  "Variant of ADP-beta-1,3-glucosyltransferase"
atgccaaacacaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcagacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagccttgctcccggtggcagcagctacgagagcctggaaagcctggttagctatattagcagcctg

SEQ ID NO: 6330 - protein, 457 aa, Artificial Sequence
  "Variant of ADP-beta-1,3-glucosyltransferase"
MPNTTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6331 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaggacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagaggctggctacctggatccggaagataaacatcgtctggaggaaccggtggtaggtttcccgatgctgaaggttaaagatatcagacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgcaggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggctggttcgtccgggcttcgtgaagggtagcgagtgggttgagccgctgccggatggttttctgggcgaacgtggtcgtatcgtgaagtcttgcccgcaacaatgggtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagccttgctcccggtggcagcagctacgagagcctggaacgcctggttagctatattagcagcctg

SEQ ID NO: 6332 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLEAGYLDPEDKHRLEEPVVGFPMLKVKDIRRAYSHWQEAKPILDKMIEETRASSGVIWNSFKELEESELETVWREIPAPSFLLPLPKHYRASSSSLQDEDPSVAQWLDQQPPSSVLYVGFGSQSEVDEKDFLEIARGLVDSKQSFLWLVRPGFVKGSEWVEPLPDGFLGERGRIVKSCPQQWVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLERLVSYISSL

SEQ ID NO: 6333 - DNA, 1371 bp, Artificial Sequence
  "Variant of ADP-beta-1,3-glucosyltransferase"
atgccaaacacaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagaggctggctacctggatccggaagataaacatcgtctggaggaaccggtggtaggtttcccgatgctgaaggttaaagatatcagacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgcaggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggctggttcgtccgggcttcgtgaagggtcgcgagtgggttgagccgctgccggatggttttctgggcgatcgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaaagcctggttagctatattagcagcctg

SEQ ID NO: 6334 - protein, 457 aa, Artificial Sequence
  "Variant of ADP-beta-1,3-glucosyltransferase"
MPNTTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLEAGYLDPEDKHRLEEPVVGFPMLKVKDIRRAYSHWQEAKPILDKMIEETRASSGVIWNSFKELEESELETVWREIPAPSFLLPLPKHYRASSSSLQDEDPSVAQWLDQQPPSSVLYVGFGSQSEVDEKDFLEIARGLVDSKQSFLWLVRPGFVKGREWVEPLPDGFLGDRGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLESLVSYISSL

SEQ ID NO: 6335 - DNA, 1371 bp, Artificial Sequence
  "Variant of ADP-beta-1,3-glucosyltransferase"
atgccaaacacaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaggacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgcaggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggctggttcgtccgggcttcgtgaagggtagcgagtgggttgagctgctgccggatggttttctgggcgatcgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaaagcctggttagctatattagcagcctg

SEQ ID NO: 6336 - protein, 457 aa, Artificial Sequence
  "Variant of ADP-beta-1,3-glucosyltransferase"
MPNTTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLQDEDPSVAQWLDQQPPSSVLYVGFGSQSEVDEKDFLEIARGLVDSKQSFLWLVRPGFVKGSEWVELLPDGFLGDRGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLESLVSYISSL

SEQ ID NO: 6337 - DNA, 1371 bp, Artificial Sequence
  "Variant of ADP-beta-1,3-glucosyltransferase"
atgccaaacacaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagaggctggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgcaggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaaagcctggttagctatattagcagcctg

SEQ ID NO: 6338 - protein, 457 aa, Artificial Sequence
  "Variant of ADP-beta-1,3-glucosyltransferase"
MPNTTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLDQFLEAGYLDPEDKHRLEEPVVGFPMLKVKDIKRAYSHWQEAKPILDKMIEETRASSGVIWNSFKELEESELETVWREIPAPSFLLPLPKHYRASSSSLQDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLESLVSYISSL

SEQ ID NO: 6339 - DNA, 1371 bp, Artificial Sequence
  "Variant of ADP-beta-1,3-glucosyltransferase"
atgccaaacacaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaggacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtcgcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6340 - protein, 457 aa, Artificial Sequence
  "Variant of ADP-beta-1,3-glucosyltransferase"
MPNTTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGREWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6341 - DNA, 1371 bp, Artificial Sequence
  "Variant of ADP-beta-1,3-glucosyltransferase"
atgccaaacacaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaggacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6342 - protein, 457 aa, Artificial Sequence
  "Variant of ADP-beta-1,3-glucosyltransferase"
MPNTTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6343 - DNA, 1371 bp, Artificial Sequence
  "Variant of ADP-beta-1,3-glucosyltransferase"
atgccaaacacaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagaggctggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggctggttcgtccgggcttcgtgaagggtcgcgagtggattgagctgctgccggatggttttctgggcgatcgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaacgcctggttagctatattagcagcctg

SEQ ID NO: 6344 - protein, 457 aa, Artificial Sequence
  "Variant of ADP-beta-1,3-glucosyltransferase"
MPNTTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLDQFLEAGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWLVRPGFVKGREWIELLPDGFLGDRGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLERLVSYISSL

SEQ ID NO: 6345 - DNA, 1371 bp, Artificial Sequence
  "Variant of ADP-beta-1,3-glucosyltransferase"
atgccaaacacaaccgaaaccaccgtgcgtcgtcgtcgtattattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagaggctggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgcaggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggctggttcgtccgggcttcgtgaagggtagcgagtgggttgagccgctgccggatggttttctgggcgaacgtggtcgtatcgtgaagtcttgcccgcaacaatgggtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaacgcctggttagctatattagcagcctg

SEQ ID NO: 6346 - protein, 457 aa, Artificial Sequence
  "Variant of ADP-beta-1,3-glucosyltransferase"
MPNTTETTVRRRRIILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLDQFLEAGYLDPEDKHRLEEPVVGFPMLKVKDIKRAYSHWQEAKPILDKMIEETRASSGVIWNSFKELEESELETVWREIPAPSFLLPLPKHYRASSSSLQDEDPSVAQWLDQQPPSSVLYVGFGSQSEVDEKDFLEIARGLVDSKQSFLWLVRPGFVKGSEWVEPLPDGFLGERGRIVKSCPQQWVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLERLVSYISSL

SEQ ID NO: 6347 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagaggctggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaaagcctggttagctatattagcagcctg

SEQ ID NO: 6348 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLPQFLEAGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLESLVSYISSL

SEQ ID NO: 6349 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgatgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagccctttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6350 - protein, 457 aa, Artificial Sequence
  "Variant of ADP-beta-1,3-glucosyltransferase"
MPNTTETTVRRRRVILFPVPFPGHLNPMMQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSPFGLDQPLNARYMSDVLHVGVYLENGLERGEIVNAIRRVMVDPEGEVMRQNAAKLKDKADRSLAPGGSSYESLESLVSYISSL

SEQ ID NO: 6351 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgcatgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6352 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPHAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6353 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgacgatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6354 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMTIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6355 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgctttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6356 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSAFGLDQPLNARYMSDVLHVGVYLENGLERGEIVNAIRRVMVDPEGEVMRQNAAKLKDKADRSLAPGGSSYESLESLVSYISSL

SEQ ID NO: 6357 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggaaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6358 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWKEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6359 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccacatctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6360 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPHLDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6361 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggttctggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6362 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGSGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6363 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaacgctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6364 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPTLDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6365 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgaatgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6366 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPNAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6367 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcttgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6368 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGLGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6369 - DNA, 1371 bp, Artificial Sequence
  "Variant of ADP-beta-1,3-glucosyltransferase"
atgccaaacacaaccgaaaccaccgtgcgtcgtcgtcgtgttattctgtttccgcagccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6370 - protein, 457 aa, Artificial Sequence
  "Variant of ADP-beta-1,3-glucosyltransferase"
MPNTTETTVRRRRVILFPQPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6371 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcactggtgtcgctggatcagtttttagagcttggctacctggatccggaagataaacatcgtctggaggaaccggtggtaggtttcccgatgctgaaggttaaagatatcaaacgcgcgtatagccactggcaggaaatgaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6372 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEMKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6373 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccacagctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6374 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPQLDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6375 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctggttgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6376 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLVARYMSDVLHVGVYLENGLERGEIVNAIRRVMVDPEGEVMRQNAAKLKDKADRSLAPGGSSYESLESLVSYISSL

SEQ ID NO: 6377 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgaccacgggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6378 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTTGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6379 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgttttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6380 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSVFGLDQPLNARYMSDVLHVGVYLENGLERGEIVNAIRRVMVDPEGEVMRQNAAKLKDKADRSLAPGGSSYESLESLVSYISSL

SEQ ID NO: 6381 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaatataaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6382 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEYKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6383 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcagtctgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6384 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQSEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6385 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcccgttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6386 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSPFGLDQPLNARYMSDVLHVGVYLENGLERGEIVNAIRRVMVDPEGEVMRQNAAKLKDKADRSLAPGGSSYESLESLVSYISSL

SEQ ID NO: 6387 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcagacggagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6388 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQTEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6389 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtaatggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6390 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGNGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6391 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgaagatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6392 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMKIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6393 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctgctttcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6394 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALLSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6395 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaacataaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6396 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEHKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6397 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgcctcatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6398 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPPHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6399 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccggttgacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6400 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPVDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6401 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtgctggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6402 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGAGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6403 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaaacgacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6404 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIETTRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6405 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagagaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6406 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEEKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6407 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtacgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6408 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGTGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6409 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccagttctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6410 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPVLDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6411 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccggatgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6412 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPDAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6413 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgtgtatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6414 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMCIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6415 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaacagaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6416 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEQKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6417 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcacgttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6418 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSTFGLDQPLNARYMSDVLHVGVYLENGLERGEIVNAIRRVMVDPEGEVMRQNAAKLKDKADRSLAPGGSSYESLESLVSYISSL

SEQ ID NO: 6419 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatggcgatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6420 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMAIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6421 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtaagggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6422 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGKGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6423 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgcatatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6424 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMHIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6425 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttgcgatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6426 - protein, 457 aa, Artificial Sequence
  "Variant of ADP-beta-1,3-glucosyltransferase"
MPNTTETTVRRRRVILFPVPFPGHLNPMLQLANVLYSRGFAITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6427 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtgacggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6428 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVTEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6429 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggtggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6430 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVVEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6431 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggctagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6432 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELASAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6433 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgcgtagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6434 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPRSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6435 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgcatagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6436 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPHSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6437 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcactgcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6438 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSTAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6439 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggattgtgaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6440 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDCEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6441 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgattccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6442 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLIPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6443 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagaatggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6444 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKNGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6445 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtgagtgaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6446 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVSEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6447 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccattttttcgaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6448 - protein, 457 aa, Artificial Sequence
  "Variant of ADP-beta-1,3-glucosyltransferase"
MPNTTETTVRRRRVILFPVPFPGHLNPMLQLANVLYSRGFSITIFSTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6449 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccggctagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6450 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPASVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6451 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtgctggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6452 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVLEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6453 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtgtgtgaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6454 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVCEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6455 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcacagtagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6456 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHSRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6457 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccattttgcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6458 - protein, 457 aa, Artificial Sequence
  "Variant of ADP-beta-1,3-glucosyltransferase"
MPNTTETTVRRRRVILFPVPFPGHLNPMLQLANVLYSRGFSITILHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6459 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggaagacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctggatcagtttttagagcttggctacctggatactgaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggacgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtgggttgagccgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcctggctcccggtggcagcagctacgagagcctggaaagcctggttagctatattagcagcctg

SEQ ID NO: 6460 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPEDEEVACLITDALWYFAQPVADSLNLPRLVLMTSSLFNFHALVSLDQFLELGYLDTEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWVEPLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSLAPGGSSYESLESLVSYISSL

SEQ ID NO: 6461 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgcagaggttttagcatcaccatttttcacaccaacttcaacgccccgaaaaccagcctttatccgcacttcagctttcgttttatcttggacaacgatccgctggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccacgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgtgtcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccattgcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcggcaaaatggaaggataaggccgatcgaagcattgctcccggtggcagcagctacgagagcctggaaagcctggttagctatattagcagcctg

SEQ ID NO: 6462 - protein, 457 aa, Artificial Sequence
  "Variant of ADP-beta-1,3-glucosyltransferase"
MPNTTETTVRRRRVILFPVPFPGHLNPMLQLANVLYRRGFSITIFHTNFNAPKTSLYPHFSFRFILDNDPLDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPCHYRASSSSLLDEDPSVAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGTMEAIAEGVPMIFSDFGLDQPLNARYMSEVLHVGVYLENGFERGEIVNAIRRVMVDPEGEVMRQNAAKWKDKADRSIAPGGSSYESLESLVSYISSL

SEQ ID NO: 6463 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgttgcattatagggcgagcagctccagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgttgcggaaggcgttccgatgatctttagcgatttcggtctggatcagccgctgaacgcgcgttacatgagcgaagttctgcatgtgggcgtttatctggagaacggctttgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6464 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRLEEPVVGFPMLKVKDIKRAYSHWQEAKPILDKMIEETRASSGVIWNSFKELEESELETVWREIPAPSFLLPLPLHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6465 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgagcctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgttgtggtatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaacgcctggttagctatattagcagcctg

SEQ ID NO: 6466 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPLWYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLERLVSYISSL

SEQ ID NO: 6467 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6468 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6469 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgtgttggtatagggcgagcagctccagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttcgagcgtggtgaaatcgtaaacgcgattaggcgtgtgatggttgaccaggaaggtgaggtgatgcgtcaaaacgcggcaaaattgaaggatttagccgatcgaagcattgctcccggtggcagcagctacgagagcctggaacgcctggttagctatattagcagcctg

SEQ ID NO: 6470 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPCWYRASSSSLLDEDPSVAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVAEGVPMIFSDFGLDQPLNARYMSDVLHVGVYLENGFERGEIVNAIRRVMVDQEGEVMRQNAAKLKDLADRSIAPGGSSYESLERLVSYISSL

SEQ ID NO: 6471 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttggagcgtggtgaaatcgtaaacgcgattaggcgtgtgatggttgacccggaaggtgaggtgatgcgtcaaaacgcggcaaaatggaaggatttattggatcgaagcattgctcccggtggcagcagctacgagagcctggaacgcctggttagctatattagcagcctg

SEQ ID NO: 6472 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGLERGEIVNAIRRVMVDPEGEVMRQNAAKWKDLLDRSIAPGGSSYESLERLVSYISSL

SEQ ID NO: 6473 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccacgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggtttcgccggaaggtgaggtgatgcgtcaaaacgcggcaaaattgaaggatttattggatcgaagcattgctcccggtggcagcagctacgagagcctggaaagcctggttagctatattagcagcctg

SEQ ID NO: 6474 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVSPEGEVMRQNAAKLKDLLDRSIAPGGSSYESLESLVSYISSL

SEQ ID NO: 6475 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccacgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagtggtatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgctgttctgcatgtgggcgtttatctggagaacggcttcgagcgtggtgaaatcgtaaacgcgattaggcgtgtgatggttgacccggaaggtgaggtgatgcgtcaaaacgcggcaaaatggaaggataaggccgatcgaagcattgctcccggtggcagcagctacgagagcctggaaagcctggttagctatattagcagcctg

SEQ ID NO: 6476 - protein, 457 aa, Artificial Sequence
  "Variant of ADP-beta-1,3-glucosyltransferase"
MPNTTETTVRRRRVILFPVPFPGHLNPMLQLANVLYRRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKWYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSAVLHVGVYLENGFERGEIVNAIRRVMVDPEGEVMRQNAAKWKDKADRSIAPGGSSYESLESLVSYISSL

SEQ ID NO: 6477 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgctggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagtggtatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccattgcggaaggcgttccgatgatctttagcgatttcggtctggatcagccgctgaacgcgcgttacatgagcgctgttctgcatgtgggcgtttatctggagaacggcttcgagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaaagcctggttagctatattagcagcctg

SEQ ID NO: 6478 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPLDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKWYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAIAEGVPMIFSDFGLDQPLNARYMSAVLHVGVYLENGFERGEIVNAIRRVMVDPEGEVMRQNAAKLKDKADRSIAPGGSSYESLESLVSYISSL

SEQ ID NO: 6479 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagtggtatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgttgcggaaggcgttccgatgatctttagcgatttcggtctggatcagccgctgaacgcgcgttacatgagcgcagttctgcatgtgggcgtttatctggagaacggctttgagcgtggtgaaatcgtaaacgcgattaggcgtgtgatggtttcgccggaaggtgaggtgatgcgtcaaaacgcgcgtaaatggaaggataagttggatcgaagcattgctcccggtggcagcagctacgagagcctggaaagcctggttagctatattagcagcctg

SEQ ID NO: 6480 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRLEEPVVGFPMLKVKDIKRAYSHWQEAKPILDKMIEETRASSGVIWNSFKELEESELETVWREIPAPSFLLPLPKWYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSAVLHVGVYLENGFERGEIVNAIRRVMVSPEGEVMRQNARKWKDKLDRSIAPGGSSYESLESLVSYISSL

SEQ ID NO: 6481 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgctggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgcagttctgcatgtgggcgtttatctggagaacggcttggagcgtggtgaaatcgtaaacgcgattaggcgtgtgatggttgacccggaaggtgaggtgatgcgtcaaaacgcgcgtaaatggaaggatttattggatcgaagcattgctcccggtggcagcagctacgagagcctggaacgcctggttagctatattagcagcctg

SEQ ID NO: 6482 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPLDEWLRNLPTHGPGAGMRIPIINKHGADEFRKELESAMRDSPSDEEVACLITDALWYFAQPVADSLNLKRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSAVLHVGVYLENGLERGEIVNAIRRVMVDPEGEVMRQNARKWKDLLDRSIAPGGSSYESLERLVSYISSL

SEQ ID NO: 6483 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgcagaggttttagcatcaccatttttcacaccaacttcaacgccccgaaaaccagcctttatccgcacttcagctttcgttttatcttggacaacgatccgctggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgatgtggtacttcgcgcaaccggtggcggacagcctgaatctgccacgtctggttctgatgaccagcagcctgtttaacttccacgcgctggtgtcgctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgtgttggtatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcgcgtaaattgaaggataaggccgatcgaagcattgctcccggtggcagcagctacgagagcctggaaagcctggttagctatattagcagcctg

SEQ ID NO: 6484 - protein, 457 aa, Artificial Sequence
  "Variant of ADP-beta-1,3-glucosyltransferase"
MPNTTETTVRRRRVILFPVPFPGHLNPMLQLANVLYRRGFSITIFHTNFNAPKTSLYPHFSFRFILDNDPLDEWLRNLPTHGPGAGMRIPIINKHGADEFRKELESAMRDSPSDEEVACLITDAMWYFAQPVADSLNLPRLVLMTSSLFNFHALVSLPQFLELGYLDPEDKHRPEEPVVGFPMLKVKDIKRAYSHWQEAKPILDKMIEETRASSGVIWNSFKELEESELETVWREIPAPSFLLPLPCWYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNARKLKDKADRSIAPGGSSYESLESLVSYISSL

SEQ ID NO: 6485 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggctttcttcgtggtgaaatcgtaaacgcgattaggcgtgtgatggttgacccggaaggtgaggtgatgcgtcaaaacgcggcaaaattgaaggataagttggatcgaagcattgctcccggtggcagcagctacgagagcctggaacgcctggttagctatattagcagcctg

SEQ ID NO: 6486 - protein, 457 aa, Artificial Sequence
  "Variant of ADP-beta-1,3-glucosyltransferase"
MPNTTETTVRRRRVILFPVPFPGHLNPMLQLANVLYRRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGFLRGEIVNAIRRVMVDPEGEVMRQNAAKLKDKLDRSIAPGGSSYESLERLVSYISSL

SEQ ID NO: 6487 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccacgtctggttctgatgaccagcagcctgtttaacttccacgcgctggtgtgcctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgttgcggaaggcgttccgatgatctttagcgatttcggtctggatcagccgctgaacgcgcgttacatgagcgaagttctgcatgtgggcgtttatctggagaacggctttcttcgtggtgaaatcgtaaacgcgattaggcgtgtgatggttttgccggaaggtgaggtgatgcgtcaaaacgcggcaaaattgaaggatttattggatcgaagcattgctcccggtggcagcagctacgagagcctggaaagcctggttagctatattagcagcctg

SEQ ID NO: 6488 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVCLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFLRGEIVNAIRRVMVLPEGEVMRQNAAKLKDLLDRSIAPGGSSYESLESLVSYISSL

SEQ ID NO: 6489 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagccagagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaaagcctggttagctatattagcagcctg

SEQ ID NO: 6490 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSQSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNARKLKDKLDRSIAPGGSSYESLESLVSYISSL

SEQ ID NO: 6491 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccacgtctggttctgatgaccagcagcctgtttaacttccacgcgctggtgtgcctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagccagagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccattgcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcgcgtaaattgaaggatttagccgatcgaagcattgctcccggtggcagcagctacgagagcctggaacgcctggttagctatattagcagcctg

SEQ ID NO: 6492 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVCLPQFLELGYLDPEDKHRLEEPVVGFPMLKVKDIKRAYSHWQEAKPILDKMIEETRASSGVIWNSFKELEESELETVWREIPAPSFLLPLPKHYRASSQSLLDEDPSVAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGTMEAIAEGVPMIFSDFGLDQPLNARYMSDVLHVGVYLENGLERGEIVNAIRRVMVDPEGEVMRQNARKLKDLADRSIAPGGSSYESLERLVSYISSL

SEQ ID NO: 6493 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccacgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagctccagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcgcgtaaattgaaggatttagccgatcgaagcattgctcccggtggcagcagctacgagagcctggaacgcctggttagctatattagcagcctg

SEQ ID NO: 6494 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNARKLKDLADRSIAPGGSSYESLERLVSYISSL

SEQ ID NO: 6495 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttagagcgtggtgaaatcgtaaacgcgattaggcgtgtgatggttgacccggaaggtgaggtgatgcgtcaaaacgcgcgtaaattgaaggatttattggatcgaagcattgctcccggtggcagcagctacgagagcctggaacgcctggttagctatattagcagcctg

SEQ ID NO: 6496 - protein, 457 aa, Artificial Sequence
  "Variant of ADP-beta-1,3-glucosyltransferase"
MPNTTETTVRRRRVILFPVPFPGHLNPMLQLANVLYRRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNARKLKDLLDRSIAPGGSSYESLERLVSYISSL

SEQ ID NO: 6497 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagtggtatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgttgcggaaggcgttccgatgatctttagcgatttcggtctggatcagccgctgaacgcgcgttacatgagcgatgttctgcatgtgggcgtttatctggagaacggcttacttcgtggtgaaatcgtaaacgcgattaggcgtgtgatggttttgccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6498 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKWYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLLRGEIVNAIRRVMVLPEGEVMRQNARKLKDKLDRSIAPGGSSYESLERLVSYISSL

SEQ ID NO: 6499 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttttgccggaaggtgaggtgatgcgtcaaaacgcggcaaaattgaaggatttattggatcgaagcattgctcccggtggcagcagctacgagagcctggaacgcctggttagctatattagcagcctg

SEQ ID NO: 6500 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVLPEGEVMRQNAAKLKDLLDRSIAPGGSSYESLERLVSYISSL

SEQ ID NO: 6501 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgtgtcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgttgcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcgcgtaaattgaaggatttagccgatcgaagcattgctcccggtggcagcagctacgagagcctggaaagcctggttagctatattagcagcctg

SEQ ID NO: 6502 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPCHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNARKLKDLADRSIAPGGSSYESLESLVSYISSL

SEQ ID NO: 6503 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgagcctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagtggtatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggctttgagcgtggtgaaatcgtaaacgcgattaggcgtgtgatggttgacccggaaggtgaggtgatgcgtcaaaacgcggcgaaatggaaggatttattggatcgaagcattgctcccggtggcagcagctacgagagcctggaaagcctggttagctatattagcagcctg

SEQ ID NO: 6504 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKWYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGFERGEIVNAIRRVMVDPEGEVMRQNAAKWKDLLDRSIAPGGSSYESLESLVSYISSL

SEQ ID NO: 6505 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccacgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagtggtatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcgcgtaaatggaaggataagttggatcgaagcattgctcccggtggcagcagctacgagagcctggaaagcctggttagctatattagcagcctg

SEQ ID NO: 6506 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKWYRASSSSLLDEDPSVAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNARKWKDKLDRSIAPGGSSYESLESLVSYISSL

SEQ ID NO: 6507 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccacgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcgcgtaaattgaaggatttagccgatcgaagcattgctcccggtggcagcagctacgagagcctggaaagcctggttagctatattagcagcctg

SEQ ID NO: 6508 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNARKLKDLADRSIAPGGSSYESLESLVSYISSL

SEQ ID NO: 6509 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagccagagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttcgagcgtggtgaaatcgtaaacgcgattaggcgtgtgatggtttcgccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6510 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSQSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGFERGEIVNAIRRVMVSPEGEVMRQNARKLKDKLDRSIAPGGSSYESLERLVSYISSL

SEQ ID NO: 6511 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccacgtctggttctgatgaccagcagcctgtttaacttccacgcgctggtgtcgctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgccggaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcaaaattgaaggatttagccgatcgaagcattgctcccggtggcagcagctacgagagcctggaacgcctggttagctatattagcagcctg

SEQ ID NO: 6512 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLPERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDLADRSIAPGGSSYESLERLVSYISSL

SEQ ID NO: 6513 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggctttgagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaacgcctggttagctatattagcagcctg

SEQ ID NO: 6514 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGFERGEIVNAIRRVMVDPEGEVMRQNAAKLKDKADRSIAPGGSSYESLERLVSYISSL

SEQ ID NO: 6515 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtcgctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagccagagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaaagcctggttagctatattagcagcctg

SEQ ID NO: 6516 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVSLPQFLELGYLDPEDKHRPEEPVVGFPMLKVKDIKRAYSHWQEAKPILDKMIEETRASSGVIWNSFKELEESELETVWREIPAPSFLLPLPKHYRASSQSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLESLVSYISSL

SEQ ID NO: 6517 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcataaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtcgctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagctccagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccattgcggaaggcgttccgatgatctttagcgatttcggtctggatcagccgctgaacgcgcgttacatgagcgatgttctgcatgtgggcgtttatctggagaacggcttccttcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6518 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVSLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAIAEGVPMIFSDFGLDQPLNARYMSDVLHVGVYLENGFLRGEIVNAIRRVMVDPEGEVMRQNARKLKDKLDRSIAPGGSSYESLERLVSYISSL

SEQ ID NO: 6519 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccacgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagctccagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgttgcggaaggcgttccgatgatctttagcgatttcggtctggatcagccgctgaacgcgcgttacatgagcgaagttctgcatgtgggcgtttatctggagaacggctttgagcgtggtgaaatcgtaaacgcgattaggcgtgtgatggttgacccggaaggtgaggtgatgcgtcaaaacgcgcgtaaattgaaggatttagccgatcgaagcattgctcccggtggcagcagctacgagagcctggaaagcctggttagctatattagcagcctg

SEQ ID NO: 6520 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDLADRSIAPGGSSYESLESLVSYISSL

SEQ ID NO: 6521 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgctggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcgcgtaaattgaaggatttattggatcgaagcattgctcccggtggcagcagctacgagagcctggaacgcctggttagctatattagcagcctg

SEQ ID NO: 6522 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPLDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNARKLKDLLDRSIAPGGSSYESLERLVSYISSL

SEQ ID NO: 6523 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgccggaaagaggtcgtatcgtgaagtcttgcccgcaacaagaagtgctggcgcacaaggcgattggtgcgttctggacccacggcggttggaacggcaccatggaggccattgcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6524 - protein, 457 aa, Artificial Sequence
  "Variant of ADP-beta-1,3-glucosyltransferase"
MPNTTETTVRRRRVILFPVPFPGHLNPMLQLANVLYRRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLPERGRIVKSCPQQEVLAHKAIGAFWTHGGWNGTMEAIAEGVPMIFSDFGLDQPLNARYMSDVLHVGVYLENGLERGEIVNAIRRVMVDPEGEVMRQNARKLKDKLDRSIAPGGSSYESLERLVSYISSL

SEQ ID NO: 6525 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgctggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgccggaaagaggtcgtatcgtgaagtcttgcccgcaacaagaagtgctggcgcacaaggcgattggtgcgttctggacccacggcggttggaacggcaccatggaggccgttgcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcgcgtaaatggaaggatttattggatcgaagcattgctcccggtggcagcagctacgagagcctggaaagcctggttagctatattagcagcctg

SEQ ID NO: 6526 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPLDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLPERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNARKWKDLLDRSIAPGGSSYESLESLVSYISSL

SEQ ID NO: 6527 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccattgcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcaaaatggaaggatttattggatcgaagcattgctcccggtggcagcagctacgagagcctggaacgcctggttagctatattagcagcctg

SEQ ID NO: 6528 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGTMEAIAEGVPMIFSDFGLDQPLNARYMSDVLHVGVYLENGLERGEIVNAIRRVMVDPEGEVMRQNAAKWKDLLDRSIAPGGSSYESLERLVSYISSL

SEQ ID NO: 6529 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttttgccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6530 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVLPEGEVMRQNARKLKDKLDRSIAPGGSSYESLERLVSYISSL

SEQ ID NO: 6531 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccacgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagtggtatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgttgcggaaggcgttccgatgatctttagcgatttcggtctggatcagccgctgaacgcgcgttacatgagcgaagttctgcatgtgggcgtttatctggagaacggcttggagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaaagcctggttagctatattagcagcctg

SEQ ID NO: 6532 - protein, 457 aa, Artificial Sequence
  "Variant of ADP-beta-1,3-glucosyltransferase"
MPNTTETTVRRRRVILFPVPFPGHLNPMLQLANVLYRRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKWYRASSSSLLDEDPSVAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVAEGVPMIFSDFGLDQPLNARYMSEVLHVGVYLENGLERGEIVNAIRRVMVDPEGEVMRQNARKLKDKLDRSIAPGGSSYESLESLVSYISSL

SEQ ID NO: 6533 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcaaaatggaaggatttattggatcgaagcattgctcccggtggcagcagctacgagagcctggaaagcctggttagctatattagcagcctg

SEQ ID NO: 6534 - protein, 457 aa, Artificial Sequence
  "Variant of ADP-beta-1,3-glucosyltransferase"
MPNTTETTVRRRRVILFPVPFPGHLNPMLQLANVLYRRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKWKDLLDRSIAPGGSSYESLESLVSYISSL

SEQ ID NO: 6535 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccacgtctggttctgatgaccagcagcctgtttaacttccacgcgctggtgtgcctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagtggtatagggcgagcagcagcagcatgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaaagcctggttagctatattagcagcctg

SEQ ID NO: 6536 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVCLPQFLELGYLDPEDKHRLEEPVVGFPMLKVKDIKRAYSHWQEAKPILDKMIEETRASSGVIWNSFKELEESELETVWREIPAPSFLLPLPKWYRASSSSMLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLESLVSYISSL

SEQ ID NO: 6537 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgtgttggtatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttcgagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaaagcctggttagctatattagcagcctg

SEQ ID NO: 6538 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPCWYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGFERGEIVNAIRRVMVDPEGEVMRQNAAKLKDKADRSIAPGGSSYESLESLVSYISSL

SEQ ID NO: 6539 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcaaaattgaaggatttattggatcgaagcattgctcccggtggcagcagctacgagagcctggaaagcctggttagctatattagcagcctg

SEQ ID NO: 6540 - protein, 457 aa, Artificial Sequence
  "Variant of ADP-beta-1,3-glucosyltransferase"
MPNTTETTVRRRRVILFPVPFPGHLNPMLQLANVLYRRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDLLDRSIAPGGSSYESLESLVSYISSL

SEQ ID NO: 6541 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgtgtcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgttgcggaaggcgttccgatgatctttagcgatttcggtctggatcagccgctgaacgcgcgttacatgagcgatgttctgcatgtgggcgtttatctggagaacggctttgagcgtggtgaaatcgtaaacgcgattaggcgtgtgatggttgacccggaaggtgaggtgatgcgtcaaaacgcgcgtaaattgaaggatttagccgatcgaagcattgctcccggtggcagcagctacgagagcctggaacgcctggttagctatattagcagcctg

SEQ ID NO: 6542 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPCHYRASSSSLLDEDPSVAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVAEGVPMIFSDFGLDQPLNARYMSDVLHVGVYLENGFERGEIVNAIRRVMVDPEGEVMRQNARKLKDLADRSIAPGGSSYESLERLVSYISSL

SEQ ID NO: 6543 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgttgcggaaggcgttccgatgatctttagcgatttcggtctggatcagccgctgaacgcgcgttacatgagcgctgttctgcatgtgggcgtttatctggagaacggctttgagcgtggtgaaatcgtaaacgcgattaggcgtgtgatggtttcgccggaaggtgaggtgatgcgtcaaaacgcggcaaaattgaaggatttagccgatcgaagcattgctcccggtggcagcagctacgagagcctggaacgcctggttagctatattagcagcctg

SEQ ID NO: 6544 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSAVLHVGVYLENGFERGEIVNAIRRVMVSPEGEVMRQNAAKLKDLADRSIAPGGSSYESLERLVSYISSL

SEQ ID NO: 6545 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtcgctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagtggtatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgttgcggaaggcgttccgatgatctttagcgatttcggtctggatcagccgctgaacgcgcgttacatgagcgctgttctgcatgtgggcgtttatctggagaacggctttgagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaacgcctggttagctatattagcagcctg

SEQ ID NO: 6546 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVSLPQFLELGYLDPEDKHRPEEPVVGFPMLKVKDIKRAYSHWQEAKPILDKMIEETRASSGVIWNSFKELEESELETVWREIPAPSFLLPLPKWYRASSSSLLDEDPSVAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVAEGVPMIFSDFGLDQPLNARYMSAVLHVGVYLENGFERGEIVNAIRRVMVDPEGEVMRQNAAKLKDKADRSIAPGGSSYESLERLVSYISSL

SEQ ID NO: 6547 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccacgtctggttctgatgaccagcagcctgtttaacttccacgcgctggtgtcgctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgtgttggtatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgcagttctgcatgtgggcgtttatctggagaacggcttcgagcgtggtgaaatcgtaaacgcgattaggcgtgtgatggttgacccggaaggtgaggtgatgcgtcaaaacgcggcaaaattgaaggatttattggatcgaagcattgctcccggtggcagcagctacgagagcctggaaagcctggttagctatattagcagcctg

SEQ ID NO: 6548 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRPEEPVVGFPMLKVKDIKRAYSHWQEAKPILDKMIEETRASSGVIWNSFKELEESELETVWREIPAPSFLLPLPCWYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSAVLHVGVYLENGFERGEIVNAIRRVMVDPEGEVMRQNAAKLKDLLDRSIAPGGSSYESLESLVSYISSL

SEQ ID NO: 6549 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagccagagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccattgcggaaggcgttccgatgatctttagcgatttcggtctggatcagccgctgaacgcgcgttacatgagcgatgttctgcatgtgggcgtttatctggagaacggcttagagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaaagcctggttagctatattagcagcctg

SEQ ID NO: 6550 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSQSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAIAEGVPMIFSDFGLDQPLNARYMSDVLHVGVYLENGLERGEIVNAIRRVMVDPEGEVMRQNAAKLKDKADRSIAPGGSSYESLESLVSYISSL

SEQ ID NO: 6551 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccattgcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaaagcctggttagctatattagcagcctg

SEQ ID NO: 6552 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAIAEGVPMIFSDFGLDQPLNARYMSDVLHVGVYLENGLERGEIVNAIRRVMVDPEGEVMRQNAAKLKDKADRSIAPGGSSYESLESLVSYISSL

SEQ ID NO: 6553 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgtgtcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccattgcggaaggcgttccgatgatctttagcgatttcggtctggatcagccgctgaacgcgcgttacatgagcgatgttctgcatgtgggcgtttatctggagaacggctttgagcgtggtgaaatcgtaaacgcgattaggcgtgtgatggttgacccggaaggtgaggtgatgcgtcaaaacgcggcaaaattgaaggataagttggatcgaagcattgctcccggtggcagcagctacgagagcctggaacgcctggttagctatattagcagcctg

SEQ ID NO: 6554 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRLEEPVVGFPMLKVKDIKRAYSHWQEAKPILDKMIEETRASSGVIWNSFKELEESELETVWREIPAPSFLLPLPCHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAIAEGVPMIFSDFGLDQPLNARYMSDVLHVGVYLENGFERGEIVNAIRRVMVDPEGEVMRQNAAKLKDKLDRSIAPGGSSYESLERLVSYISSL

SEQ ID NO: 6555 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgctggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagtggtatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaggccgatcgaagcattgctcccggtggcagcagctacgagagcctggaacgcctggttagctatattagcagcctg

SEQ ID NO: 6556 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPLDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKWYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLERLVSYISSL

SEQ ID NO: 6557 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgctggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcaaaattgaaggatttattggatcgaagcattgctcccggtggcagcagctacgagagcctggaaagcctggttagctatattagcagcctg

SEQ ID NO: 6558 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPLDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDLLDRSIAPGGSSYESLESLVSYISSL

SEQ ID NO: 6559 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagtggtatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttttgccggaaggtgaggtgatgcgtcaaaacgcggcgaaactgaaggataaagcggatcgaagcattgctcccggtggcagcagctacgagagcctggaaagcctggttagctatattagcagcctg

SEQ ID NO: 6560 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKWYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVLPEGEVMRQNAAKLKDKADRSIAPGGSSYESLESLVSYISSL

SEQ ID NO: 6561 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgctggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccacgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagccagagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcaaaattgaaggataagttggatcgaagcattgctcccggtggcagcagctacgagagcctggaacgcctggttagctatattagcagcctg

SEQ ID NO: 6562 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPLDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSQSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKLDRSIAPGGSSYESLERLVSYISSL

SEQ ID NO: 6563 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcaaaattgaaggataagttggatcgaagcattgctcccggtggcagcagctacgagagcctggaacgcctggttagctatattagcagcctg

SEQ ID NO: 6564 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKLDRSIAPGGSSYESLERLVSYISSL

SEQ ID NO: 6565 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccacgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgttgcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggctttgagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaaagcctggttagctatattagcagcctg

SEQ ID NO: 6566 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPLHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGFERGEIVNAIRRVMVDPEGEVMRQNAAKLKDKADRSIAPGGSSYESLESLVSYISSL

SEQ ID NO: 6567 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccacgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagtggtatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccattgcggaaggcgttccgatgatctttagcgatttcggtctggatcagccgctgaacgcgcgttacatgagcgaagttctgcatgtgggcgtttatctggagaacggcttggagcgtggtgaaatcgtaaacgcgattaggcgtgtgatggttgacccggaaggtgaggtgatgcgtcaaaacgcgcgtaaatggaaggatttagccgatcgaagcattgctcccggtggcagcagctacgagagcctggaacgcctggttagctatattagcagcctg

SEQ ID NO: 6568 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKWYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAIAEGVPMIFSDFGLDQPLNARYMSEVLHVGVYLENGLERGEIVNAIRRVMVDPEGEVMRQNARKWKDLADRSIAPGGSSYESLERLVSYISSL

SEQ ID NO: 6569 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgctggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccacgtctggttctgatgaccagcagcctgtttaacttccacgcgctggtgagcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccattgcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcgcgtaaattgaaggatttagccgatcgaagcattgctcccggtggcagcagctacgagagcctggaaagcctggttagctatattagcagcctg

SEQ ID NO: 6570 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPLDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAIAEGVPMIFSDFGLDQPLNARYMSDVLHVGVYLENGLERGEIVNAIRRVMVDPEGEVMRQNARKLKDLADRSIAPGGSSYESLESLVSYISSL

SEQ ID NO: 6571 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagtggtatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaaagcctggttagctatattagcagcctg

SEQ ID NO: 6572 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRLEEPVVGFPMLKVKDIKRAYSHWQEAKPILDKMIEETRASSGVIWNSFKELEESELETVWREIPAPSFLLPLPKWYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGLERGEIVNAIRRVMVDPEGEVMRQNAAKLKDKADRSIAPGGSSYESLESLVSYISSL

SEQ ID NO: 6573 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagtggtatagggcgagcagcgccagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgttgcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaacgcctggttagctatattagcagcctg

SEQ ID NO: 6574 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKWYRASSASLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLERLVSYISSL

SEQ ID NO: 6575 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccattgcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaaagcctggttagctatattagcagcctg

SEQ ID NO: 6576 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAIAEGVPMIFSDFGLDQPLNARYMSDVLHVGVYLENGLERGEIVNAIRRVMVDPEGEVMRQNAAKLKDKADRSIAPGGSSYESLESLVSYISSL

SEQ ID NO: 6577 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccacgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagtggtatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaacgcctggttagctatattagcagcctg

SEQ ID NO: 6578 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKWYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLERLVSYISSL

SEQ ID NO: 6579 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagtggtatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgttgcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttttgccggaaggtgaggtgatgcgtcaaaacgcggcgaaactgaaggataaagcggatcgaagcattgctcccggtggcagcagctacgagagcctggaacgcctggttagctatattagcagcctg

SEQ ID NO: 6580 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKWYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVLPEGEVMRQNAAKLKDKADRSIAPGGSSYESLERLVSYISSL

SEQ ID NO: 6581 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcaaaattgaaggatttagccgatcgaagcattgctcccggtggcagcagctacgagagcctggaaagcctggttagctatattagcagcctg

SEQ ID NO: 6582 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDLADRSIAPGGSSYESLESLVSYISSL

SEQ ID NO: 6583 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagtggtatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgttgcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcaaaattgaaggatttattggatcgaagcattgctcccggtggcagcagctacgagagcctggaaagcctggttagctatattagcagcctg

SEQ ID NO: 6584 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKWYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDLLDRSIAPGGSSYESLESLVSYISSL

SEQ ID NO: 6585 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccacgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccattgcggaaggcgttccgatgatctttagcgatttcggtctggatcagccgctgaacgcgcgttacatgagcgatgttctgcatgtgggcgtttatctggagaacggctttcttcgtggtgaaatcgtaaacgcgattaggcgtgtgatggttgacccggaaggtgaggtgatgcgtcaaaacgcggcaaaatggaaggatttattggatcgaagcattgctcccggtggcagcagctacgagagcctggaaagcctggttagctatattagcagcctg

SEQ ID NO: 6586 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAIAEGVPMIFSDFGLDQPLNARYMSDVLHVGVYLENGFLRGEIVNAIRRVMVDPEGEVMRQNAAKWKDLLDRSIAPGGSSYESLESLVSYISSL

SEQ ID NO: 6587 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgagcctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgttgcggaaggcgttccgatgatctttagcgatttcggtctggatcagccgctgaacgcgcgttacatgagcgatgttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataaggccgatcgaagcattgctcccggtggcagcagctacgagagcctggaaagcctggttagctatattagcagcctg

SEQ ID NO: 6588 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGFERGEIVNAIRRVMVDPEGEVMRQNARKLKDKADRSIAPGGSSYESLESLVSYISSL

SEQ ID NO: 6589 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtcggagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaaagcctggttagctatattagcagcctg

SEQ ID NO: 6590 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGRRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLESLVSYISSL

SEQ ID NO: 6591 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgcagaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaacgcctggttagctatattagcagcctg

SEQ ID NO: 6592 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLQTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLERLVSYISSL

SEQ ID NO: 6593 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaaagcctggttagctatattagcagcctg

SEQ ID NO: 6594 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPQINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLESLVSYISSL

SEQ ID NO: 6595 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcaggtatgagaatcccgaatattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaacgcctggttagctatattagcagcctg

SEQ ID NO: 6596 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPNINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLERLVSYISSL

SEQ ID NO: 6597 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgactattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaacgcctggttagctatattagcagcctg

SEQ ID NO: 6598 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPTINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLERLVSYISSL

SEQ ID NO: 6599 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccacatgaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaacgcctggttagctatattagcagcctg

SEQ ID NO: 6600 - protein, 457 aa, Artificial Sequence
  "Variant of ADP-beta-1,3-glucosyltransferase"
MPNTTETTVRRRRVILFPVPFPGHMNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLERLVSYISSL

SEQ ID NO: 6601 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacatgccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaacgcctggttagctatattagcagcctg

SEQ ID NO: 6602 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNMPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLERLVSYISSL

SEQ ID NO: 6603 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtcagagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaaagcctggttagctatattagcagcctg

SEQ ID NO: 6604 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGQRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLESLVSYISSL

SEQ ID NO: 6605 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtaagagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaaagcctggttagctatattagcagcctg

SEQ ID NO: 6606 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGKRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLESLVSYISSL

SEQ ID NO: 6607 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggctgtatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaaagcctggttagctatattagcagcctg

SEQ ID NO: 6608 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGCMEAVAEGVPMIFSDFGLDQPLNARYMSDVLHVGVYLENGLERGEIVNAIRRVMVDPEGEVMRQNAAKLKDKADRSIAPGGSSYESLESLVSYISSL

SEQ ID NO: 6609 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccacattaacccgatgctgcaactggcgaacgtgctgtacagcagaggttttagcatcaccatttttcacaccaacttcaatgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaacgcctggttagctatattagcagcctg

SEQ ID NO: 6610 - protein, 457 aa, Artificial Sequence
  "Variant of ADP-beta-1,3-glucosyltransferase"
MPNTTETTVRRRRVILFPVPFPGHINPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLERLVSYISSL

SEQ ID NO: 6611 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtgctagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaacgcctggttagctatattagcagcctg

SEQ ID NO: 6612 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGARIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLERLVSYISSL

SEQ ID NO: 6613 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtgagagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattcctgcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaaagcctggttagctatattagcagcctg

SEQ ID NO: 6614 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGERIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLESLVSYISSL

SEQ ID NO: 6615 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgttctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaaagcctggttagctatattagcagcctg

SEQ ID NO: 6616 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHVLVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLESLVSYISSL

SEQ ID NO: 6617 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacactctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaacgcctggttagctatattagcagcctg

SEQ ID NO: 6618 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHTLVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLERLVSYISSL

SEQ ID NO: 6619 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccagaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggctttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaacgcctggttagctatattagcagcctg

SEQ ID NO: 6620 - protein, 457 aa, Artificial Sequence
  "Variant of ADP-beta-1,3-glucosyltransferase"
MPNTTETTVRRRRVILFPVPFPGHQNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLERLVSYISSL

SEQ ID NO: 6621 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccacagtaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaaagcctggttagctatattagcagcctg

SEQ ID NO: 6622 - protein, 457 aa, Artificial Sequence
  "Variant of ADP-beta-1,3-glucosyltransferase"
MPNTTETTVRRRRVILFPVPFPGHSNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLESLVSYISSL

SEQ ID NO: 6623 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgctccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaaagcctggttagctatattagcagcctg

SEQ ID NO: 6624 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNAPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLESLVSYISSL

SEQ ID NO: 6625 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccggtgattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaaagcctggttagctatattagcagcctg

SEQ ID NO: 6626 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPVINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLESLVSYISSL

SEQ ID NO: 6627 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgcttattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaaagcctggttagctatattagcagcctg

SEQ ID NO: 6628 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPLINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLESLVSYISSL

SEQ ID NO: 6629 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgttatgcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaacgcctggttagctatattagcagcctg

SEQ ID NO: 6630 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVMREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLERLVSYISSL

SEQ ID NO: 6631 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggttatgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaaagcctggttagctatattagcagcctg

SEQ ID NO: 6632 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGYEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLESLVSYISSL

SEQ ID NO: 6633 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgttgtgcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaaagcctggttagctatattagcagcctg

SEQ ID NO: 6634 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVVREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLESLVSYISSL

SEQ ID NO: 6635 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctaatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttcgcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaaagcctggttagctatattagcagcctg

SEQ ID NO: 6636 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVSREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLESLVSYISSL

SEQ ID NO: 6637 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtcttagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaacgcctggttagctatattagcagcctg

SEQ ID NO: 6638 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRLSSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLERLVSYISSL

SEQ ID NO: 6639 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgttcttcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaacgcctggttagctatattagcagcctg

SEQ ID NO: 6640 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVLREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLERLVSYISSL

SEQ ID NO: 6641 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcaagccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaaagcctggttagctatattagcagcctg

SEQ ID NO: 6642 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGKPMIFSDFGLDQPLNARYMSDVLHVGVYLENGLERGEIVNAIRRVMVDPEGEVMRQNAAKLKDKADRSIAPGGSSYESLESLVSYISSL

SEQ ID NO: 6643 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgagattatgcgtcaaaacgcggcgaaactgaaggataaagcggatcgaagcattgctcccggtggcagcagctacgagagcctggaaagcctggttagctatattagcagcctg

SEQ ID NO: 6644 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEIMRQNAAKLKDKADRSIAPGGSSYESLESLVSYISSL

SEQ ID NO: 6645 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttgtcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaaagcctggttagctatattagcagcctg

SEQ ID NO: 6646 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVCREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLESLVSYISSL

SEQ ID NO: 6647 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgttcagcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaacgcctggttagctatattagcagcctg

SEQ ID NO: 6648 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVQREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLERLVSYISSL

SEQ ID NO: 6649 - DNA, 1371 bp, Artificial Sequence
  "Variant of ADP-beta-1,3-glucosyltransferase"
atgccaaacacaaccccgaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaaagcctggttagctatattagcagcctg

SEQ ID NO: 6650 - protein, 457 aa, Artificial Sequence
  "Variant of ADP-beta-1,3-glucosyltransferase"
MPNTTPTTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLESLVSYISSL

SEQ ID NO: 6651 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcaccctgcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaacgcctggttagctatattagcagcctg

SEQ ID NO: 6652 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHPAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLERLVSYISSL

SEQ ID NO: 6653 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaggtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaacgcctggttagctatattagcagcctg

SEQ ID NO: 6654 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPRFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLERLVSYISSL

SEQ ID NO: 6655 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgaagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaaagcctggttagctatattagcagcctg

SEQ ID NO: 6656 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPKFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLESLVSYISSL

SEQ ID NO: 6657 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggaccctaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaacgcctggttagctatattagcagcctg

SEQ ID NO: 6658 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLERLVSYISSL

SEQ ID NO: 6659 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaatctcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaaagcctggttagctatattagcagcctg

SEQ ID NO: 6660 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKSRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLESLVSYISSL

SEQ ID NO: 6661 - DNA, 1371 bp, Artificial Sequence
  "Variant of ADP-beta-1,3-glucosyltransferase"
atgccaaacacatcggaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaacgcctggttagctatattagcagcctg

SEQ ID NO: 6662 - protein, 457 aa, Artificial Sequence
  "Variant of ADP-beta-1,3-glucosyltransferase"
MPNTSETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLERLVSYISSL

SEQ ID NO: 6663 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgttggtcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaaagcctggttagctatattagcagcctg

SEQ ID NO: 6664 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVGREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLESLVSYISSL

SEQ ID NO: 6665 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaatgtagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaaagcctggttagctatattagcagcctg

SEQ ID NO: 6666 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKCSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLESLVSYISSL

SEQ ID NO: 6667 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgttgctcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaaagcctggttagctatattagcagcctg

SEQ ID NO: 6668 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVAREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLESLVSYISSL

SEQ ID NO: 6669 - DNA, 1371 bp, Artificial Sequence
  "Variant of ADP-beta-1,3-glucosyltransferase"
atgccaaacacaaccgaaaccaccgtgaagcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaaagcctggttagctatattagcagcctg

SEQ ID NO: 6670 - protein, 457 aa, Artificial Sequence
  "Variant of ADP-beta-1,3-glucosyltransferase"
MPNTTETTVKRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLESLVSYISSL

SEQ ID NO: 6671 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgttaggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaaagcctggttagctatattagcagcctg

SEQ ID NO: 6672 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVRREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLESLVSYISSL

SEQ ID NO: 6673 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaaactcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaacgcctggttagctatattagcagcctg

SEQ ID NO: 6674 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKTRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLERLVSYISSL

SEQ ID NO: 6675 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgccgcgtctggttctgatgaccagcagcctgtttaacttccacgcgctggtgtcgctgccgcagtttttagagcttggctacctggatccggaagataaacatcgtctggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcactatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaagtgagctttctgtggcgggttcgtccgggcttcgtgaagggtagcgagtggattgagctgctgccggatggttttctgggcgaacgtggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgatgttctgcatgtgggcgtttatctggagaacggcttggagcgtggtgaaatcgtaaacgcgattaggcgtgtgatggttgacccggaaggtgaggtgatgcgtcaaaacgcggcgaaactgaaggataaagcggatcgaagcattgctcccggtggcagcagctacgagagcctggaaagcctggttagctatattagcagcctg

SEQ ID NO: 6676 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLPRLVLMTSSLFNFHALVSLPQFLELGYLDPEDKHRLEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKVSFLWRVRPGFVKGSEWIELLPDGFLGERGRIVKSCPQQEVLAHKAIGAFWTHGGWNGTMEAVAEGVPMIFSDFGLDQPLNARYMSDVLHVGVYLENGLERGEIVNAIRRVMVDPEGEVMRQNAAKLKDKADRSIAPGGSSYESLESLVSYISSL

SEQ ID NO: 6677 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcagacagagtggcttcgcaacctgccgacccacggttcgaacgcgggtatgacgatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaagaagccaaaccacacctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcgcgagcctgctggatgaagatccgagcgttgcccaatggctggaccagcaaccgccgcgcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtttgtgaaggcgttccgatgatctttagcccgttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6678 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQTEWLRNLPTHGSNAGMTIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPHLDKMIEETRASSGVIWNSFKELEESELETVWREIPAPSFLLPLPKHYRASSASLLDEDPSVAQWLDQQPPRSVLYVGFGSQSEVDEKDFLEIARGLVDSKQSFLWRVRPGFVKGSEWIELLPDGFLGERGRIVKSCPQQEVLAHKAIGAFWTHGGWNGTMEAVCEGVPMIFSPFGLDQPLNARYMSEVLHVGVYLENGFERGEIVNAIRRVMVDPEGEVMRQNARKLKDKLDRSIAPGGSSYESLERLVSYISSL

SEQ ID NO: 6679 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccattttgcacaccaacttcaacgccccgaaaaccagcctttatccgcacttcagctttcgttttatcttggacaacgatccgcagacagagtggcttcgcaacctgccgacccatggtccgggcgcgggtatgacgatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaagaagccaaaccaatcctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgttgcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtttgtgaaggcgttccgatgatctttagcgacttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6680 - protein, 457 aa, Artificial Sequence
  "Variant of ADP-beta-1,3-glucosyltransferase"
MPNTTETTVRRRRVILFPVPFPGHLNPMLQLANVLYSRGFSITILHTNFNAPKTSLYPHFSFRFILDNDPQTEWLRNLPTHGPGAGMTIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6681 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccacggttcgggcgcgggtatgacgatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgttgcccaatggctggaccagcaaccgccgcgcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgttgttgaaggcgttccgatgatctttagcccgttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataaattggatcgaagcattgctcccggtggcagcagctacgagagcctggaacgcctggttagctatattagcagcctg

SEQ ID NO: 6682 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGSGAGMTIPIINKHGADEFRKELESAMRDSPSDEEVACLITDALWYFAQPVADSLNLKRLVLMTSSLFNFHALLCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPRSVLYVGFGSQSEVDEKDFLEIARGLVDSKQSFLWRVRPGFVKGSEWIELLPDGFLGERGRIVKSCPQQEVLAHKAIGAFWTHGGWNGTMEAVVEGVPMIFSPFGLDQPLNARYMSEVLHVGVYLENGFERGEIVNAIRRVMVDPEGEVMRQNARKLKDKLDRSIAPGGSSYESLERLVSYISSL

SEQ ID NO: 6683 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgaccacaggtccgggcgcgggtatgacgatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagctcgagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcccgttcggtctggatcagccgctgaacgcgcgttacatgagcgaagttctgcatgtgggcgtttatctggagaacggcttcctccgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6684 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTTGPGAGMTIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSPFGLDQPLNARYMSEVLHVGVYLENGFLRGEIVNAIRRVMVDPEGEVMRQNARKLKDKLDRSIAPGGSSYESLERLVSYISSL

SEQ ID NO: 6685 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgcagaggttttagcatcaccatttttcacaccaacttcaacgccccgaaaaccagcctttatccgcacttcagctttcgttttatcttggacaacgatccgcagacagagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggaaagaagccaaaccaatcctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgttgcccaatggctggaccagcaaccgccgcgcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtggcggaaggcgttccgatgatctttagcccgttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggatctgttggatcgaagcattgctcccggtggcagcagctacgagagcctggaacgcctggttagctatattagcagcctg

SEQ ID NO: 6686 - protein, 457 aa, Artificial Sequence
  "Variant of ADP-beta-1,3-glucosyltransferase"
MPNTTETTVRRRRVILFPVPFPGHLNPMLQLANVLYRRGFSITIFHTNFNAPKTSLYPHFSFRFILDNDPQTEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWKEAKPILDKMIEETRASSGVIWNSFKELEESELETVWREIPAPSFLLPLPKHYRASSSSLLDEDPSVAQWLDQQPPRSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVAEGVPMIFSPFGLDQPLNARYMSEVLHVGVYLENGFERGEIVNAIRRVMVDPEGEVMRQNARKLKDLLDRSIAPGGSSYESLERLVSYISSL

SEQ ID NO: 6687 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcagacagagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagagcttggctacctggatccggaagataaacatcgtccggaggaaccggtggtaggtttcccgatgctgaaggttaaagatatcagacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgttgcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataaattggatcgaagcattgctcccggtggcagcagctacgagagcctggaacgcctggttagctatattagcagcctg

SEQ ID NO: 6688 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQTEWLRNLPTHGPGAGMRIPIINKHGADEFRKELESAMRDSPSDEEVACLITDALWYFAQPVADSLNLKRLVLMTSSLFNFHALLCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6689 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagtggtatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcccgttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6690 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKWYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSPFGLDQPLNARYMSEVLHVGVYLENGFERGEIVNAIRRVMVDPEGEVMRQNARKLKDKLDRSIAPGGSSYESLERLVSYISSL

SEQ ID NO: 6691 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcagacagagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagtggtatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6692 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQTEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKWYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6693 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgaccacaggttcgggcgcgggtatgaggatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaagaagccaaaccacacctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccatttgtgaaggcgttccgatgatctttagcgatttcggtctggatcagccgctgaacgcgcgttacatgagcgaagttctgcatgtgggcgtttatctggagaacggcttcctccgtggtgaaatcgtaaacgcgattaggcgtgtgatggttgacccggaaggtgaggtgatgcgtcaaaacgcgcgtaaattgaaggataaattggatcgaagcattgctcccggtggcagcagctacgagagcctggaacgcctggttagctatattagcagcctg

SEQ ID NO: 6694 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTTGSGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPHLDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAICEGVPMIFSDFGLDQPLNARYMSEVLHVGVYLENGFLRGEIVNAIRRVMVDPEGEVMRQNARKLKDKLDRSIAPGGSSYESLERLVSYISSL

SEQ ID NO: 6695 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaagaacaaaaaccaatcctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagctcgagcctgctggatgaagatccgagcacggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccatttgtgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6696 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEQKPILDKMIEETRASSGVIWNSFKELEESELETVWREIPAPSFLLPLPKHYRASSSSLLDEDPSTAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGTMEAICEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6697 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccatttgtgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6698 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAICEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6699 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccattttgcacaccaacttcaacgccccgaaaaccagcctttatccgcacttcagctttcgttttatcttggacaacgatccgcagacagagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatacggaagataaacatcgtccggaggaaccggtggtaggtttcccgatgctgaaggttaaagatatcaaacgcgcgtatagccactggcaagaagccaaaccaatcctggataagatgattgaagaaacccgtgcgagcagcggtgtgatttggaacagctttaaagagctggaggaaagcgagctggaaaccgtttggcgtgaaattccggcgccgagcttcctgattccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccatttgtgaaggcgttccgatgatctttagcgacttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaatggaaggatctgttggatcgaagcattgctcccggtggcagcagctacgagagcctggaacgcctggttagctatattagcagcctg

SEQ ID NO: 6700 - protein, 457 aa, Artificial Sequence
  "Variant of ADP-beta-1,3-glucosyltransferase"
MPNTTETTVRRRRVILFPVPFPGHLNPMLQLANVLYSRGFSITILHTNFNAPKTSLYPHFSFRFILDNDPQTEWLRNLPTHGPGAGMRIPIINKHGADEFRKELESAMRDSPSDEEVACLITDALWYFAQPVADSLNLKRLVLMTSSLFNFHALVCLPQFLELGYLDTEDKHRPEEPVVGFPMLKVKDIKRAYSHWQEAKPILDKMIEETRASSGVIWNSFKELEESELETVWREIPAPSFLIPLPKHYRASSSSLLDEDPSVAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGTMEAICEGVPMIFSDFGLDQPLNARYMSEVLHVGVYLENGFERGEIVNAIRRVMVDPEGEVMRQNARKWKDLLDRSIAPGGSSYESLERLVSYISSL

SEQ ID NO: 6701 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcagacagagtggcttcgcaacctgccgacccacggttcgggcgcgggtatgacgatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgattccgctgccgaagcattatagggcgagcagcagcagcctgctggatgaagatccgagcacggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccatttgtgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6702 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQTEWLRNLPTHGSGAGMTIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLIPLPKHYRASSSSLLDEDPSTAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGTMEAICEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6703 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgaccacaggttcgggcgcgggtatgaggatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcagacgcgcgtatagccactggcaagaagccaaaccaatcctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagctcgagcctgctggatgaagatccgagcacggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccatttgtgaaggcgttccgatgatctttagcgacttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6704 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTTGSGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAICEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6705 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgcagaggttttagcatcaccatttttcacaccaacttcaacgccccgaaaaccagcctttatccgcacttcagctttcgttttatcttggacaacgatccgcagacagagtggcttcgcaacctgccgaccacaggttcgggcgcgggtatgacgatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagagcttggctacctggatccggaagataaacatcgtccggaggaaccggtggtaggtttcccgatgctgaaggttaaagatatcagacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6706 - protein, 457 aa, Artificial Sequence
  "Variant of ADP-beta-1,3-glucosyltransferase"
MPNTTETTVRRRRVILFPVPFPGHLNPMLQLANVLYRRGFSITIFHTNFNAPKTSLYPHFSFRFILDNDPQTEWLRNLPTTGSGAGMTIPIINKHGADEFRKELESAMRDSPSDEEVACLITDALWYFAQPVADSLNLKRLVLMTSSLFNFHALLCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6707 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccattttgcacaccaacttcaacgccccgaaaaccagcctttatccgcacttcagctttcgttttatcttggacaacgatccgcagacagagtggcttcgcaacctgccgacccacggtccgaacgcgggtatgacgatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggaaagaagccaaaccaatcctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcccgttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6708 - protein, 457 aa, Artificial Sequence
  "Variant of ADP-beta-1,3-glucosyltransferase"
MPNTTETTVRRRRVILFPVPFPGHLNPMLQLANVLYSRGFSITILHTNFNAPKTSLYPHFSFRFILDNDPQTEWLRNLPTHGPNAGMTIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWKEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSPFGLDQPLNARYMSEVLHVGVYLENGFERGEIVNAIRRVMVDPEGEVMRQNARKLKDKLDRSIAPGGSSYESLERLVSYISSL

SEQ ID NO: 6709 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccattttccacaccaacttcaacgccccgaaaaccagcctttatccgcacttcagctttcgttttatcttggacaacgatccgcaggacgagtggcttcgcaacctgccgacccacggtccgaacgcgggtatgaggatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggaaagaagccaaaccaatcctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtttgtgaaggcgttccgatgatctttagcgatttcggtctggatcagccgctgaacgcgcgttacatgagcgaagttctgcatgtgggcgtttatctggagaacggcttcctccgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6710 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPNAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWKEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVCEGVPMIFSDFGLDQPLNARYMSEVLHVGVYLENGFLRGEIVNAIRRVMVDPEGEVMRQNARKLKDKLDRSIAPGGSSYESLERLVSYISSL

SEQ ID NO: 6711 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccattttgcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagaggcaggctacctggatacggaagataaacatcgtccggaggaaccggtggtaggtttcccgatgctgaaggttaaagatatcagacgcgcgtatagccactggcaagaacaaaaaccaatcctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtttgtgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaatggaaggatctgttggatcgaagcattgctcccggtggcagcagctacgagagcctggaacgcctggttagctatattagcagcctg

SEQ ID NO: 6712 - protein, 457 aa, Artificial Sequence
  "Variant of ADP-beta-1,3-glucosyltransferase"
MPNTTETTVRRRRVILFPVPFPGHLNPMLQLANVLYSRGFSITILHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLEAGYLDTEDKHRPEEPVVGFPMLKVKDIRRAYSHWQEQKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKWKDLLDRSIAPGGSSYESLERLVSYISSL

SEQ ID NO: 6713 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccacggtccgaacgcgggtatgaggatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagagcttggctacctggatacggaagataaacatcgtccggaggaaccggtggtaggtttcccgatgctgaaggttaaagatatcaaacgcgcgtatagccactggaaagaacaaaaaccaatcctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgttgcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgttgttgaaggcgttccgatgatctttagcccgttcggtctggatcagccgctggttgcgcgttacatgagcgaagttctgcatgtgggcgtttatctggagaacggcttcctccgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6714 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPNAGMRIPIINKHGADEFRKELESAMRDSPSDEEVACLITDALWYFAQPVADSLNLKRLVLMTSSLFNFHALLCLPQFLELGYLDTEDKHRPEEPVVGFPMLKVKDIKRAYSHWKEQKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVVEGVPMIFSPFGLDQPLVARYMSEVLHVGVYLENGFLRGEIVNAIRRVMVDPEGEVMRQNARKLKDKLDRSIAPGGSSYESLERLVSYISSL

SEQ ID NO: 6715 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgaggatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcagacgcgcgtatagccactggcaagaacaaaaaccacacctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgttgcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtttgtgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6716 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEQKPHLDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6717 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcagacgcgcgtatagccactggcaagaagccaaaccacacctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6718 - protein, 457 aa, Artificial Sequence
  "Variant of ADP-beta-1,3-glucosyltransferase"
MPNTTETTVRRRRVILFPVPFPGHLNPMLQLANVLYRRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPHLDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6719 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcagacagagtggcttcgcaacctgccgacccacggttcgaacgcgggtatgaggatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggaaagaagccaaaccacacctggataagatgattgaagaaacccgtgcgagcagcggtgtgatttggaacagctttaaagagctggaggaaagcgagctggaaaccgtttggcgtgaaattccggcgccgagcttcctgattccgctgccgaagcattatagggcgagcagcagcagcctgctggatgaagatccgagcacggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccatttgtgaaggcgttccgatgatctttagcgacttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataaattggatcgaagcattgctcccggtggcagcagctacgagagcctggaacgcctggttagctatattagcagcctg

SEQ ID NO: 6720 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQTEWLRNLPTHGSNAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWKEAKPHLDKMIEETRASSGVIWNSFKELEESELETVWREIPAPSFLIPLPKHYRASSSSLLDEDPSTAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAICEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6721 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggaaagaacaaaaaccacacctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagctcgagcctgctggatgaagatccgagcgttgcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6722 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWKEQKPHLDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6723 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccacggtccgaacgcgggtatgaggatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatacggaagataaacatcgtccggaggaaccggtggtaggtttcccgatgctgaaggttaaagatatcaaacgcgcgtatagccactggaaagaagccaaaccacacctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcacggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtttgtgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6724 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPNAGMRIPIINKHGADEFRKELESAMRDSPSDEEVACLITDALWYFAQPVADSLNLKRLVLMTSSLFNFHALVCLPQFLELGYLDTEDKHRPEEPVVGFPMLKVKDIKRAYSHWKEAKPHLDKMIEETRASSGVIWNSFKELEESELETVWREIPAPSFLLPLPKHYRASSSSLLDEDPSTAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6725 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccattttccacaccaacttcaacgccccgaaaaccagcctttatccgcacttcagctttcgttttatcttggacaacgatccgcaggacgagtggcttcgcaacctgccgacccacggtccgggcgcgggtatgaggatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggaaagaagccaaaccacacctggataagatgattgaagaaacccgtgcgagcagcggtgtgatttggaacagctttaaagagctggaggaaagcgagctggaaaccgtttggcgtgaaattccggcgccgagcttcctgcttccgctgccgaagtggtatagggcgagcagcagcagcctgctggatgaagatccgagcgttgcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6726 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWKEAKPHLDKMIEETRASSGVIWNSFKELEESELETVWREIPAPSFLLPLPKWYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6727 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggaaagaagccaaaccaatcctggataagatgattgaagaaacccgtgcgagcagcggtgtgatttggaacagctttaaagagctggaggaaagcgagctggaaaccgtttggcgtgaaattccggcgccgagcttcctgcttccgctgccgaagtggtatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataaattggatcgaagcattgctcccggtggcagcagctacgagagcctggaacgcctggttagctatattagcagcctg

SEQ ID NO: 6728 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWKEAKPILDKMIEETRASSGVIWNSFKELEESELETVWREIPAPSFLLPLPKWYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6729 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgcagaggttttagcatcaccatttttcacaccaacttcaacgccccgaaaaccagcctttatccgcacttcagctttcgttttatcttggacaacgatccgcaggacgagtggcttcgcaacctgccgacccacggttcgggcgcgggtatgaggatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcacggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccattgttgaaggcgttccgatgatctttagcccgttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6730 - protein, 457 aa, Artificial Sequence
  "Variant of ADP-beta-1,3-glucosyltransferase"
MPNTTETTVRRRRVILFPVPFPGHLNPMLQLANVLYRRGFSITIFHTNFNAPKTSLYPHFSFRFILDNDPQDEWLRNLPTHGSGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSTAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAIVEGVPMIFSPFGLDQPLNARYMSEVLHVGVYLENGFERGEIVNAIRRVMVDPEGEVMRQNARKLKDKLDRSIAPGGSSYESLERLVSYISSL

SEQ ID NO: 6731 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccattttgcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagaggcaggctacctggatacggaagataaacatcgtccggaggaaccggtggtaggtttcccgatgctgaaggttaaagatatcaaacgcgcgtatagccactggaaagaagccaaaccaatcctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcacggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccatttgtgaaggcgttccgatgatctttagcgacttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6732 - protein, 457 aa, Artificial Sequence
  "Variant of ADP-beta-1,3-glucosyltransferase"
MPNTTETTVRRRRVILFPVPFPGHLNPMLQLANVLYSRGFSITILHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLEAGYLDTEDKHRPEEPVVGFPMLKVKDIKRAYSHWKEAKPILDKMIEETRASSGVIWNSFKELEESELETVWREIPAPSFLLPLPKHYRASSSSLLDEDPSTAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGTMEAICEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6733 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccattttgcacaccaacttcaacgccccgaaaaccagcctttatccgcacttcagctttcgttttatcttggacaacgatccgcagacagagtggcttcgcaacctgccgacccatggtccgggcgcgggtatgaggatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagaggcaggctacctggatccggaagataaacatcgtccggaggaaccggtggtaggtttcccgatgctgaaggttaaagatatcaaacgcgcgtatagccactggcaagaagccaaaccacacctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgttgcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccattgttgaaggcgttccgatgatctttagcccgttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataaattggatcgaagcattgctcccggtggcagcagctacgagagcctggaacgcctggttagctatattagcagcctg

SEQ ID NO: 6734 - protein, 457 aa, Artificial Sequence
  "Variant of ADP-beta-1,3-glucosyltransferase"
MPNTTETTVRRRRVILFPVPFPGHLNPMLQLANVLYSRGFSITILHTNFNAPKTSLYPHFSFRFILDNDPQTEWLRNLPTHGPGAGMRIPIINKHGADEFRKELESAMRDSPSDEEVACLITDALWYFAQPVADSLNLKRLVLMTSSLFNFHALVCLPQFLEAGYLDPEDKHRPEEPVVGFPMLKVKDIKRAYSHWQEAKPHLDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAIVEGVPMIFSPFGLDQPLNARYMSEVLHVGVYLENGFERGEIVNAIRRVMVDPEGEVMRQNARKLKDKLDRSIAPGGSSYESLERLVSYISSL

SEQ ID NO: 6735 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccattttccacaccaacttcaacgccccgaaaaccagcctttatccgcacttcagctttcgttttatcttggacaacgatccgcagacagagtggcttcgcaacctgccgaccacaggtccgaacgcgggtatgaggatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcagacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagtggtatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgacttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6736 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQTEWLRNLPTTGPNAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKWYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6737 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgaccacaggttcgggcgcgggtatgaggatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggacgataaacatcgtccggaggaaccggtggtaggtttcccgatgctgaaggttaaagatatcagacgcgcgtatagccactggcaagaagccaaaccaatcctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcacggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6738 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTTGSGAGMRIPIINKHGADEFRKELESAMRDSPSDEEVACLITDALWYFAQPVADSLNLKRLVLMTSSLFNFHALVCLPQFLELGYLDPDDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6739 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccattttgcacaccaacttcaacgccccgaaaaccagcctttatccgcacttcagctttcgttttatcttggacaacgatccgcaggacgagtggcttcgcaacctgccgacccacggtccgaacgcgggtatgaggatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatacggaagataaacatcgtccggaggaaccggtggtaggtttcccgatgctgaaggttaaagatatcagacgcgcgtatagccactggcaagaacaaaaaccaatcctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcgcgagcctgctggatgaagatccgagcgtggcccaatggctggaccagcaaccgccgcgcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccatttgtgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6740 - protein, 457 aa, Artificial Sequence
  "Variant of ADP-beta-1,3-glucosyltransferase"
MPNTTETTVRRRRVILFPVPFPGHLNPMLQLANVLYSRGFSITILHTNFNAPKTSLYPHFSFRFILDNDPQDEWLRNLPTHGPNAGMRIPIINKHGADEFRKELESAMRDSPSDEEVACLITDALWYFAQPVADSLNLKRLVLMTSSLFNFHALVCLPQFLELGYLDTEDKHRPEEPVVGFPMLKVKDIRRAYSHWQEQKPILDKMIEETRASSGVIWNSFKELEESELETVWREIPAPSFLLPLPKHYRASSASLLDEDPSVAQWLDQQPPRSVLYVGFGSQSEVDEKDFLEIARGLVDSKQSFLWRVRPGFVKGSEWIELLPDGFLGERGRIVKSCPQQEVLAHKAIGAFWTHGGWNGTMEAICEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6741 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccattgctgaaggcgttccgatgatctttagcccgttcggtctggatcagccgctgaacgcgcgttacatgagcgaagttctgcatgtgggcgtttatctggagaacggcttcctccgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6742 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAIAEGVPMIFSPFGLDQPLNARYMSEVLHVGVYLENGFLRGEIVNAIRRVMVDPEGEVMRQNARKLKDKLDRSIAPGGSSYESLERLVSYISSL

SEQ ID NO: 6743 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccattttccacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagagcttggctacctggatacggaagataaacatcgtccggaggaaccggtggtaggtttcccgatgctgaaggttaaagatatcagacgcgcgtatagccactggaaagaacaaaaaccaatcctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagctcgagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtttgtgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6744 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALLCLPQFLELGYLDTEDKHRPEEPVVGFPMLKVKDIRRAYSHWKEQKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6745 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgattccgctgccgaagtggtatagggcgagcagcagcagcctgctggatgaagatccgagcgtggcccaatggctggaccagcaaccgccgcgtagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggatctggcggatcgaagcattgctcccggtggcagcagctacgagagcctggaacgcctggttagctatattagcagcctg

SEQ ID NO: 6746 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQTEWLRNLPTHGPGAGMRIPIINKHGADEFRKELESAMRDSPSDEEVACLITDALWYFAQPVADSLNLKRLVLMTSSLFNFHALLCLPQFLELGYLDPEDKHRPEEPVVGFPMLKVKDIRRAYSHWQEAKPILDKMIEETRASSGVIWNSFKELEESELETVWREIPAPSFLIPLPKWYRASSSSLLDEDPSVAQWLDQQPPRSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDLADRSIAPGGSSYESLERLVSYISSL

SEQ ID NO: 6747 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagaggcgggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgttccgatgatctttagcccgttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6748 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQTEWLRNLPTHGPGAGMRIPIINKHGADEFRKELESAMRDSPSDEEVACLITDALWYFAQPVADSLNLKRLVLMTSSLFNFHALLCLPQFLEAGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVCEGVPMIFSPFGLDQPLNARYMSEVLHVGVYLENGFERGEIVNAIRRVMVDPEGEVMRQNARKLKDKLDRSIAPGGSSYESLERLVSYISSL

SEQ ID NO: 6749 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcagaccgagtggcttcgcaacctgccgaccaccggtagcaacgcgggtatgaccatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6750 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQTEWLRNLPTTGSNAGMTIPIINKHGADEFRKELESAMRDSPSDEEVACLITDALWYFAQPVADSLNLKRLVLMTSSLFNFHALLCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6751 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtgtgcgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggatctggcggatcgaagcattgctcccggtggcagcagctacgagagcctggaacgcctggttagctatattagcagcctg

SEQ ID NO: 6752 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALLCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSTAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDLADRSIAPGGSSYESLERLVSYISSL

SEQ ID NO: 6753 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcccgttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6754 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQTEWLRNLPTHGPGAGMRIPIINKHGADEFRKELESAMRDSPSDEEVACLITDALWYFAQPVADSLNLKRLVLMTSSLFNFHALLCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSTAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSPFGLDQPLNARYMSEVLHVGVYLENGFERGEIVNAIRRVMVDPEGEVMRQNARKLKDKLDRSIAPGGSSYESLERLVSYISSL

SEQ ID NO: 6755 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtgtgcgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggatctggcggatcgaagcattgctcccggtggcagcagctacgagagcctggaacgcctggttagctatattagcagcctg

SEQ ID NO: 6756 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALLCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDLADRSIAPGGSSYESLERLVSYISSL

SEQ ID NO: 6757 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcagaccgagtggcttcgcaacctgccgaccaccggtagcaacgcgggtatgaccatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagaggcgggctacctggataccgaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtggcggaaggcgttccgatgatctttagcccgttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6758 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQTEWLRNLPTTGSNAGMTIPIINKHGADEFRKELESAMRDSPSDEEVACLITDALWYFAQPVADSLNLKRLVLMTSSLFNFHALVCLPQFLEAGYLDTEDKHRPEEPVVGFPMLKVKDIKRAYSHWQEAKPILDKMIEETRASSGVIWNSFKELEESELETVWREIPAPSFLLPLPKHYRASSSSLLDEDPSTAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVAEGVPMIFSPFGLDQPLNARYMSEVLHVGVYLENGFERGEIVNAIRRVMVDPEGEVMRQNARKLKDKLDRSIAPGGSSYESLERLVSYISSL

SEQ ID NO: 6759 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtgtgcgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6760 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALLCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6761 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagaggcgggctacctggataccgaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgattccgctgccgaagtggtatagggcgagcagcagcagcctgctggatgaagatccgagcgtggcccaatggctggaccagcaaccgccgcgtagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtggtggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggatctggcggatcgaagcattgctcccggtggcagcagctacgagagcctggaacgcctggttagctatattagcagcctg

SEQ ID NO: 6762 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQTEWLRNLPTHGPGAGMRIPIINKHGADEFRKELESAMRDSPSDEEVACLITDALWYFAQPVADSLNLKRLVLMTSSLFNFHALLCLPQFLEAGYLDTEDKHRPEEPVVGFPMLKVKDIKRAYSHWQEAKPILDKMIEETRASSGVIWNSFKELEESELETVWREIPAPSFLIPLPKWYRASSSSLLDEDPSVAQWLDQQPPRSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVVEGVPMIFSDFGLDQPLNARYMSEVLHVGVYLENGFERGEIVNAIRRVMVDPEGEVMRQNARKLKDLADRSIAPGGSSYESLERLVSYISSL

SEQ ID NO: 6763 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgcgtagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtggtggaaggcgttccgatgatctttagcccgttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6764 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQTEWLRNLPTHGPGAGMRIPIINKHGADEFRKELESAMRDSPSDEEVACLITDALWYFAQPVADSLNLKRLVLMTSSLFNFHALLCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPRSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVVEGVPMIFSPFGLDQPLNARYMSEVLHVGVYLENGFERGEIVNAIRRVMVDPEGEVMRQNARKLKDKLDRSIAPGGSSYESLERLVSYISSL

SEQ ID NO: 6765 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgattccgctgccgaagtggtatagggcgagcagcagcagcctgctggatgaagatccgagcgtggcccaatggctggaccagcaaccgccgcgtagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaagataagttggatcgaagcattgctcccggtggcagcagctacgagagcctggaacgcctggttagctatattagcagcctg

SEQ ID NO: 6766 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLIPLPKWYRASSSSLLDEDPSVAQWLDQQPPRSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6767 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcaggacgagtggcttcgcaacctgccgaccaccggtagcaacgcgggtatgaccatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagaggcgggctacctggataccgaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgcgtagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgttccgatgatctttagcccgttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6768 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQDEWLRNLPTTGSNAGMTIPIINKHGADEFRKELESAMRDSPSDEEVACLITDALWYFAQPVADSLNLKRLVLMTSSLFNFHALVCLPQFLEAGYLDTEDKHRPEEPVVGFPMLKVKDIKRAYSHWQEAKPILDKMIEETRASSGVIWNSFKELEESELETVWREIPAPSFLLPLPKHYRASSSSLLDEDPSTAQWLDQQPPRSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVCEGVPMIFSPFGLDQPLNARYMSEVLHVGVYLENGFERGEIVNAIRRVMVDPEGEVMRQNARKLKDKLDRSIAPGGSSYESLERLVSYISSL

SEQ ID NO: 6769 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgcgtagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtgtgcgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6770 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQTEWLRNLPTHGPGAGMRIPIINKHGADEFRKELESAMRDSPSDEEVACLITDALWYFAQPVADSLNLKRLVLMTSSLFNFHALLCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPRSVLYVGFGSQSEVDEKDFLEIARGLVDSKQSFLWRVRPGFVKGSEWIELLPDGFLGERGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6771 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagagcttggctacctggataccgaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagtggtatagggcgagcagcagcagcctgctggatgaagatccgagcgtggcccaatggctggaccagcaaccgccgcgtagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtggcggaaggcgttccgatgatctttagcccgttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6772 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALLCLPQFLELGYLDTEDKHRPEEPVVGFPMLKVKDIKRAYSHWQEAKPILDKMIEETRASSGVIWNSFKELEESELETVWREIPAPSFLLPLPKWYRASSSSLLDEDPSVAQWLDQQPPRSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVAEGVPMIFSPFGLDQPLNARYMSEVLHVGVYLENGFERGEIVNAIRRVMVDPEGEVMRQNARKLKDKLDRSIAPGGSSYESLERLVSYISSL

SEQ ID NO: 6773 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagaggcgggctacctggataccgaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtggcggaaggcgttccgatgatctttagcccgttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6774 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALLCLPQFLEAGYLDTEDKHRPEEPVVGFPMLKVKDIKRAYSHWQEAKPILDKMIEETRASSGVIWNSFKELEESELETVWREIPAPSFLLPLPKHYRASSSSLLDEDPSTAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVAEGVPMIFSPFGLDQPLNARYMSEVLHVGVYLENGFERGEIVNAIRRVMVDPEGEVMRQNARKLKDKLDRSIAPGGSSYESLERLVSYISSL

SEQ ID NO: 6775 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtggtggaaggcgttccgatgatctttagcccgttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggatctggcggatcgaagcattgctcccggtggcagcagctacgagagcctggaacgcctggttagctatattagcagcctg

SEQ ID NO: 6776 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQTEWLRNLPTHGPGAGMRIPIINKHGADEFRKELESAMRDSPSDEEVACLITDALWYFAQPVADSLNLKRLVLMTSSLFNFHALLCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVVEGVPMIFSPFGLDQPLNARYMSEVLHVGVYLENGFERGEIVNAIRRVMVDPEGEVMRQNARKLKDLADRSIAPGGSSYESLERLVSYISSL

SEQ ID NO: 6777 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtggtggaaggcgttccgatgatctttagcccgttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6778 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALLCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVVEGVPMIFSPFGLDQPLNARYMSEVLHVGVYLENGFERGEIVNAIRRVMVDPEGEVMRQNARKLKDKLDRSIAPGGSSYESLERLVSYISSL

SEQ ID NO: 6779 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgaccaccggtagcaacgcgggtatgaccatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagaggcgggctacctggataccgaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgcgtagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtggcggaaggcgttccgatgatctttagcccgttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6780 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTTGSNAGMTIPIINKHGADEFRKELESAMRDSPSDEEVACLITDALWYFAQPVADSLNLKRLVLMTSSLFNFHALLCLPQFLEAGYLDTEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPRSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVAEGVPMIFSPFGLDQPLNARYMSEVLHVGVYLENGFERGEIVNAIRRVMVDPEGEVMRQNARKLKDKLDRSIAPGGSSYESLERLVSYISSL

SEQ ID NO: 6781 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcagaccgagtggcttcgcaacctgccgaccaccggtagcaacgcgggtatgaccatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagaggcgggctacctggataccgaagataaacatcgtccggaggaaccggtggtaggtttcccgatgctgaaggttaaagatatccgtcgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgattccgctgccgaagcattatagggcgagcagcagcagcctgctggatgaagatccgagcaccgcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6782 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQTEWLRNLPTTGSNAGMTIPIINKHGADEFRKELESAMRDSPSDEEVACLITDALWYFAQPVADSLNLKRLVLMTSSLFNFHALVCLPQFLEAGYLDTEDKHRPEEPVVGFPMLKVKDIRRAYSHWQEAKPILDKMIEETRASSGVIWNSFKELEESELETVWREIPAPSFLIPLPKHYRASSSSLLDEDPSTAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6783 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagtggtatagggcgagcagcagcagcctgctggatgaagatccgagcaccgcccaatggctggaccagcaaccgccgcgtagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtgtgcgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6784 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQTEWLRNLPTHGPGAGMRIPIINKHGADEFRKELESAMRDSPSDEEVACLITDALWYFAQPVADSLNLKRLVLMTSSLFNFHALLCLPQFLELGYLDPEDKHRPEEPVVGFPMLKVKDIKRAYSHWQEAKPILDKMIEETRASSGVIWNSFKELEESELETVWREIPAPSFLLPLPKWYRASSSSLLDEDPSTAQWLDQQPPRSVLYVGFGSQSEVDEKDFLEIARGLVDSKQSFLWRVRPGFVKGSEWIELLPDGFLGERGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6785 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagagcttggctacctggataccgaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcccgttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6786 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALLCLPQFLELGYLDTEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSPFGLDQPLNARYMSEVLHVGVYLENGFERGEIVNAIRRVMVDPEGEVMRQNARKLKDKLDRSIAPGGSSYESLERLVSYISSL

SEQ ID NO: 6787 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttgcgatcaccattctgcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagaggcgggctacctggataccgaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgattccgctgccgaagtggtatagggcgagcagcagcagcctgctggatgaagatccgagcgtggcccaatggctggaccagcaaccgccgcgtagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtgtgcgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggatctgttggatcgaagcattgctcccggtggcagcagctacgagagcctggaacgcctggttagctatattagcagcctg

SEQ ID NO: 6788 - protein, 457 aa, Artificial Sequence
  "Variant of ADP-beta-1,3-glucosyltransferase"
MPNTTETTVRRRRVILFPVPFPGHLNPMLQLANVLYSRGFAITILHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLEAGYLDTEDKHRPEEPVVGFPMLKVKDIKRAYSHWQEAKPILDKMIEETRASSGVIWNSFKELEESELETVWREIPAPSFLIPLPKWYRASSSSLLDEDPSVAQWLDQQPPRSVLYVGFGSQSEVDEKDFLEIARGLVDSKQSFLWRVRPGFVKGSEWIELLPDGFLGERGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDLLDRSIAPGGSSYESLERLVSYISSL

SEQ ID NO: 6789 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcccgttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6790 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALLCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSPFGLDQPLNARYMSEVLHVGVYLENGFERGEIVNAIRRVMVDPEGEVMRQNARKLKDKLDRSIAPGGSSYESLERLVSYISSL

SEQ ID NO: 6791 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcagaccgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgattccgctgccgaagtggtatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggtggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggatctggcggatcgaagcattgctcccggtggcagcagctacgagagcctggaacgcctggttagctatattagcagcctg

SEQ ID NO: 6792 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQTEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLIPLPKWYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVVEGVPMIFSDFGLDQPLNARYMSEVLHVGVYLENGFERGEIVNAIRRVMVDPEGEVMRQNARKLKDLADRSIAPGGSSYESLERLVSYISSL

SEQ ID NO: 6793 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcagaccgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgattccgctgccgaagtggtatagggcgagcagcagcagcctgctggatgaagatccgagcgtggcccaatggctggaccagcaaccgccgcgtagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggtggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggatctggcggatcgaagcattgctcccggtggcagcagctacgagagcctggaacgcctggttagctatattagcagcctg

SEQ ID NO: 6794 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQTEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLIPLPKWYRASSSSLLDEDPSVAQWLDQQPPRSVLYVGFGSQSEVDEKDFLEIARGLVDSKQSFLWRVRPGFVKGSEWIELLPDGFLGERGRIVKSCPQQEVLAHKAIGAFWTHGGWNGTMEAVVEGVPMIFSDFGLDQPLNARYMSEVLHVGVYLENGFERGEIVNAIRRVMVDPEGEVMRQNARKLKDLADRSIAPGGSSYESLERLVSYISSL

SEQ ID NO: 6795 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtggcggaaggcgttccgatgatctttagcccgttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6796 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQTEWLRNLPTHGPGAGMRIPIINKHGADEFRKELESAMRDSPSDEEVACLITDALWYFAQPVADSLNLKRLVLMTSSLFNFHALLCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSTAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVAEGVPMIFSPFGLDQPLNARYMSEVLHVGVYLENGFERGEIVNAIRRVMVDPEGEVMRQNARKLKDKLDRSIAPGGSSYESLERLVSYISSL

SEQ ID NO: 6797 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcagaccgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgcgtagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtggcggaaggcgttccgatgatctttagcccgttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggatctgttggatcgaagcattgctcccggtggcagcagctacgagagcctggaacgcctggttagctatattagcagcctg

SEQ ID NO: 6798 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQTEWLRNLPTHGPGAGMRIPIINKHGADEFRKELESAMRDSPSDEEVACLITDALWYFAQPVADSLNLKRLVLMTSSLFNFHALLCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPRSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVAEGVPMIFSPFGLDQPLNARYMSEVLHVGVYLENGFERGEIVNAIRRVMVDPEGEVMRQNARKLKDLLDRSIAPGGSSYESLERLVSYISSL

SEQ ID NO: 6799 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcagaccgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgattccgctgccgaagtggtatagggcgagcagcagcagcctgctggatgaagatccgagcaccgcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggtggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggatctggcggatcgaagcattgctcccggtggcagcagctacgagagcctggaacgcctggttagctatattagcagcctg

SEQ ID NO: 6800 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQTEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLIPLPKWYRASSSSLLDEDPSTAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVVEGVPMIFSDFGLDQPLNARYMSEVLHVGVYLENGFERGEIVNAIRRVMVDPEGEVMRQNARKLKDLADRSIAPGGSSYESLERLVSYISSL

SEQ ID NO: 6801 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgaccaccggtagcaacgcgggtatgaccatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgttccgatgatctttagcccgttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6802 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQTEWLRNLPTTGSNAGMTIPIINKHGADEFRKELESAMRDSPSDEEVACLITDALWYFAQPVADSLNLKRLVLMTSSLFNFHALLCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVCEGVPMIFSPFGLDQPLNARYMSEVLHVGVYLENGFERGEIVNAIRRVMVDPEGEVMRQNARKLKDKLDRSIAPGGSSYESLERLVSYISSL

SEQ ID NO: 6803 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcaggacgagtggcttcgcaacctgccgaccaccggtagcaacgcgggtatgaccatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagagcttggctacctggataccgaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtggcggaaggcgttccgatgatctttagcccgttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6804 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQDEWLRNLPTTGSNAGMTIPIINKHGADEFRKELESAMRDSPSDEEVACLITDALWYFAQPVADSLNLKRLVLMTSSLFNFHALLCLPQFLELGYLDTEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVAEGVPMIFSPFGLDQPLNARYMSEVLHVGVYLENGFERGEIVNAIRRVMVDPEGEVMRQNARKLKDKLDRSIAPGGSSYESLERLVSYISSL

SEQ ID NO: 6805 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgaccaccggtagcaacgcgggtatgaccatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtggcggaaggcgttccgatgatctttagcccgttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6806 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQTEWLRNLPTTGSNAGMTIPIINKHGADEFRKELESAMRDSPSDEEVACLITDALWYFAQPVADSLNLKRLVLMTSSLFNFHALLCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVAEGVPMIFSPFGLDQPLNARYMSEVLHVGVYLENGFERGEIVNAIRRVMVDPEGEVMRQNARKLKDKLDRSIAPGGSSYESLERLVSYISSL

SEQ ID NO: 6807 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagtggtatagggcgagcagcagcagcctgctggatgaagatccgagcaccgcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6808 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQTEWLRNLPTHGPGAGMRIPIINKHGADEFRKELESAMRDSPSDEEVACLITDALWYFAQPVADSLNLKRLVLMTSSLFNFHALLCLPQFLELGYLDPEDKHRPEEPVVGFPMLKVKDIRRAYSHWQEAKPILDKMIEETRASSGVIWNSFKELEESELETVWREIPAPSFLLPLPKWYRASSSSLLDEDPSTAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6809 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtgtgcgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggatctggcggatcgaagcattgctcccggtggcagcagctacgagagcctggaacgcctggttagctatattagcagcctg

SEQ ID NO: 6810 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQTEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSTAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDLADRSIAPGGSSYESLERLVSYISSL

SEQ ID NO: 6811 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgcgtagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtgtgcgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6812 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQTEWLRNLPTHGPGAGMRIPIINKHGADEFRKELESAMRDSPSDEEVACLITDALWYFAQPVADSLNLKRLVLMTSSLFNFHALLCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPRSVLYVGFGSQSEVDEKDFLEIARGLVDSKQSFLWRVRPGFVKGSEWIELLPDGFLGERGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6813 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgaccaccggtagcaacgcgggtatgaccatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgcgtagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtggcggaaggcgttccgatgatctttagcccgttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggatctgttggatcgaagcattgctcccggtggcagcagctacgagagcctggaacgcctggttagctatattagcagcctg

SEQ ID NO: 6814 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQTEWLRNLPTTGSNAGMTIPIINKHGADEFRKELESAMRDSPSDEEVACLITDALWYFAQPVADSLNLKRLVLMTSSLFNFHALLCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSTAQWLDQQPPRSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVAEGVPMIFSPFGLDQPLNARYMSEVLHVGVYLENGFERGEIVNAIRRVMVDPEGEVMRQNARKLKDLLDRSIAPGGSSYESLERLVSYISSL

SEQ ID NO: 6815 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtggcggaaggcgttccgatgatctttagcccgttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggatctgttggatcgaagcattgctcccggtggcagcagctacgagagcctggaacgcctggttagctatattagcagcctg

SEQ ID NO: 6816 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSTAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVAEGVPMIFSPFGLDQPLNARYMSEVLHVGVYLENGFERGEIVNAIRRVMVDPEGEVMRQNARKLKDLLDRSIAPGGSSYESLERLVSYISSL

SEQ ID NO: 6817 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6818 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQTEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6819 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgaccaccggtagcaacgcgggtatgaccatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgcgtagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggatctgttggatcgaagcattgctcccggtggcagcagctacgagagcctggaacgcctggttagctatattagcagcctg

SEQ ID NO: 6820 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTTGSNAGMTIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSTAQWLDQQPPRSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDLLDRSIAPGGSSYESLERLVSYISSL

SEQ ID NO: 6821 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgaccaccggtagcaacgcgggtatgaccatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtgtgcgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6822 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTTGSNAGMTIPIINKHGADEFRKELESAMRDSPSDEEVACLITDALWYFAQPVADSLNLKRLVLMTSSLFNFHALLCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6823 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgaccatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagagcttggctacctggataccgaagataaacatcgtccggaggaaccggtggtaggtttcccgatgctgaaggttaaagatatccgtcgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgttccgatgatctttagcccgttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggatctgttggatcgaagcattgctcccggtggcagcagctacgagagcctggaacgcctggttagctatattagcagcctg

SEQ ID NO: 6824 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQTEWLRNLPTHGPGAGMTIPIINKHGADEFRKELESAMRDSPSDEEVACLITDALWYFAQPVADSLNLKRLVLMTSSLFNFHALLCLPQFLELGYLDTEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVCEGVPMIFSPFGLDQPLNARYMSEVLHVGVYLENGFERGEIVNAIRRVMVDPEGEVMRQNARKLKDLLDRSIAPGGSSYESLERLVSYISSL

SEQ ID NO: 6825 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagaggcgggctacctggataccgaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtgtgcgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggatctggcggatcgaagcattgctcccggtggcagcagctacgagagcctggaacgcctggttagctatattagcagcctg

SEQ ID NO: 6826 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQTEWLRNLPTHGPGAGMRIPIINKHGADEFRKELESAMRDSPSDEEVACLITDALWYFAQPVADSLNLKRLVLMTSSLFNFHALLCLPQFLEAGYLDTEDKHRPEEPVVGFPMLKVKDIKRAYSHWQEAKPILDKMIEETRASSGVIWNSFKELEESELETVWREIPAPSFLLPLPKHYRASSSSLLDEDPSTAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDLADRSIAPGGSSYESLERLVSYISSL

SEQ ID NO: 6827 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgaccaccggtagcaacgcgggtatgaccatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggtggaaggcgttccgatgatctttagcccgttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6828 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTTGSNAGMTIPIINKHGADEFRKELESAMRDSPSDEEVACLITDALWYFAQPVADSLNLKRLVLMTSSLFNFHALLCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSTAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVVEGVPMIFSPFGLDQPLNARYMSEVLHVGVYLENGFERGEIVNAIRRVMVDPEGEVMRQNARKLKDKLDRSIAPGGSSYESLERLVSYISSL

SEQ ID NO: 6829 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagaggcgggctacctggataccgaagataaacatcgtccggaggaaccggtggtaggtttcccgatgctgaaggttaaagatatccgtcgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgattccgctgccgaagcattatagggcgagcagcagcagcctgctggatgaagatccgagcaccgcccaatggctggaccagcaaccgccgcgtagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggatctgttggatcgaagcattgctcccggtggcagcagctacgagagcctggaacgcctggttagctatattagcagcctg

SEQ ID NO: 6830 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQTEWLRNLPTHGPGAGMRIPIINKHGADEFRKELESAMRDSPSDEEVACLITDALWYFAQPVADSLNLKRLVLMTSSLFNFHALLCLPQFLEAGYLDTEDKHRPEEPVVGFPMLKVKDIRRAYSHWQEAKPILDKMIEETRASSGVIWNSFKELEESELETVWREIPAPSFLIPLPKHYRASSSSLLDEDPSTAQWLDQQPPRSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDLLDRSIAPGGSSYESLERLVSYISSL

SEQ ID NO: 6831 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgaccaccggtagcaacgcgggtatgaccatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagtggtatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcccgttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6832 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQTEWLRNLPTTGSNAGMTIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKWYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSPFGLDQPLNARYMSEVLHVGVYLENGFERGEIVNAIRRVMVDPEGEVMRQNARKLKDKLDRSIAPGGSSYESLERLVSYISSL

SEQ ID NO: 6833 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcagaccgagtggcttcgcaacctgccgaccaccggtagcaacgcgggtatgaccatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagaggcgggctacctggataccgaagataaacatcgtccggaggaaccggtggtaggtttcccgatgctgaaggttaaagatatccgtcgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtgtgcgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6834 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQTEWLRNLPTTGSNAGMTIPIINKHGADEFRKELESAMRDSPSDEEVACLITDALWYFAQPVADSLNLKRLVLMTSSLFNFHALLCLPQFLEAGYLDTEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6835 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6836 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQTEWLRNLPTHGPGAGMRIPIINKHGADEFRKELESAMRDSPSDEEVACLITDALWYFAQPVADSLNLKRLVLMTSSLFNFHALLCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6837 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcagaccgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtgtgcgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6838 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQTEWLRNLPTHGPGAGMRIPIINKHGADEFRKELESAMRDSPSDEEVACLITDALWYFAQPVADSLNLKRLVLMTSSLFNFHALLCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6839 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgcgtagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6840 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQTEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPRSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6841 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcagaccgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6842 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQTEWLRNLPTHGPGAGMRIPIINKHGADEFRKELESAMRDSPSDEEVACLITDALWYFAQPVADSLNLKRLVLMTSSLFNFHALLCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6843 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtgtgcgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6844 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQTEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6845 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgaccaccggtagcaacgcgggtatgaccatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcccgttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6846 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTTGSNAGMTIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSPFGLDQPLNARYMSEVLHVGVYLENGFERGEIVNAIRRVMVDPEGEVMRQNARKLKDKLDRSIAPGGSSYESLERLVSYISSL

SEQ ID NO: 6847 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcagaccgagtggcttcgcaacctgccgaccaccggtagcaacgcgggtatgaccatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtgtgcgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6848 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQTEWLRNLPTTGSNAGMTIPIINKHGADEFRKELESAMRDSPSDEEVACLITDALWYFAQPVADSLNLKRLVLMTSSLFNFHALLCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6849 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcagaccgagtggcttcgcaacctgccgaccaccggtagcaacgcgggtatgaccatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgcgtagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtggcggaaggcgttccgatgatctttagcccgttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6850 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQTEWLRNLPTTGSNAGMTIPIINKHGADEFRKELESAMRDSPSDEEVACLITDALWYFAQPVADSLNLKRLVLMTSSLFNFHALLCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPRSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVAEGVPMIFSPFGLDQPLNARYMSEVLHVGVYLENGFERGEIVNAIRRVMVDPEGEVMRQNARKLKDKLDRSIAPGGSSYESLERLVSYISSL

SEQ ID NO: 6851 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtggtggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggatctggcggatcgaagcattgctcccggtggcagcagctacgagagcctggaacgcctggttagctatattagcagcctg

SEQ ID NO: 6852 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVVEGVPMIFSDFGLDQPLNARYMSEVLHVGVYLENGFERGEIVNAIRRVMVDPEGEVMRQNARKLKDLADRSIAPGGSSYESLERLVSYISSL

SEQ ID NO: 6853 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgaccatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagagcttggctacctggataccgaagataaacatcgtccggaggaaccggtggtaggtttcccgatgctgaaggttaaagatatccgtcgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtggcggaaggcgttccgatgatctttagcccgttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6854 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQTEWLRNLPTHGPGAGMTIPIINKHGADEFRKELESAMRDSPSDEEVACLITDALWYFAQPVADSLNLKRLVLMTSSLFNFHALLCLPQFLELGYLDTEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVAEGVPMIFSPFGLDQPLNARYMSEVLHVGVYLENGFERGEIVNAIRRVMVDPEGEVMRQNARKLKDKLDRSIAPGGSSYESLERLVSYISSL

SEQ ID NO: 6855 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgaccaccggtagcaacgcgggtatgaccatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagaggcgggctacctggataccgaagataaacatcgtccggaggaaccggtggtaggtttcccgatgctgaaggttaaagatatccgtcgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtggcggaaggcgttccgatgatctttagcccgttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6856 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQTEWLRNLPTTGSNAGMTIPIINKHGADEFRKELESAMRDSPSDEEVACLITDALWYFAQPVADSLNLKRLVLMTSSLFNFHALLCLPQFLEAGYLDTEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVAEGVPMIFSPFGLDQPLNARYMSEVLHVGVYLENGFERGEIVNAIRRVMVDPEGEVMRQNARKLKDKLDRSIAPGGSSYESLERLVSYISSL

SEQ ID NO: 6857 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcagaccgagtggcttcgcaacctgccgaccaccggtagcaacgcgggtatgaccatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgcgtagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtggtggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggatctgttggatcgaagcattgctcccggtggcagcagctacgagagcctggaacgcctggttagctatattagcagcctg

SEQ ID NO: 6858 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQTEWLRNLPTTGSNAGMTIPIINKHGADEFRKELESAMRDSPSDEEVACLITDALWYFAQPVADSLNLKRLVLMTSSLFNFHALLCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPRSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVVEGVPMIFSDFGLDQPLNARYMSEVLHVGVYLENGFERGEIVNAIRRVMVDPEGEVMRQNARKLKDLLDRSIAPGGSSYESLERLVSYISSL

SEQ ID NO: 6859 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtggtggaaggcgttccgatgatctttagcccgttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggatctggcggatcgaagcattgctcccggtggcagcagctacgagagcctggaacgcctggttagctatattagcagcctg

SEQ ID NO: 6860 - protein, 457 aa, Artificial Sequence
  "Variant of ADP-beta-1,3-glucosyltransferase"
MPNTTETTVRRRRVILFPVPFPGHLNPMLQLANVLYSRGFAITILHTNFNAPKTSLYPHFSFRFILDNDPQTEWLRNLPTHGPGAGMRIPIINKHGADEFRKELESAMRDSPSDEEVACLITDALWYFAQPVADSLNLKRLVLMTSSLFNFHALLCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSTAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVVEGVPMIFSPFGLDQPLNARYMSEVLHVGVYLENGFERGEIVNAIRRVMVDPEGEVMRQNARKLKDLADRSIAPGGSSYESLERLVSYISSL

SEQ ID NO: 6861 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgaccaccggtagcaacgcgggtatgaccatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtggtggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggatctggcggatcgaagcattgctcccggtggcagcagctacgagagcctggaacgcctggttagctatattagcagcctg

SEQ ID NO: 6862 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQTEWLRNLPTTGSNAGMTIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVVEGVPMIFSDFGLDQPLNARYMSEVLHVGVYLENGFERGEIVNAIRRVMVDPEGEVMRQNARKLKDLADRSIAPGGSSYESLERLVSYISSL

SEQ ID NO: 6863 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6864 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQTEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6865 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcaggacgagtggcttcgcaacctgccgaccaccggtagcaacgcgggtatgaccatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagagcttggctacctggataccgaagataaacatcgtccggaggaaccggtggtaggtttcccgatgctgaaggttaaagatatccgtcgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgattccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6866 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQDEWLRNLPTTGSNAGMTIPIINKHGADEFRKELESAMRDSPSDEEVACLITDALWYFAQPVADSLNLKRLVLMTSSLFNFHALLCLPQFLELGYLDTEDKHRPEEPVVGFPMLKVKDIRRAYSHWQEAKPILDKMIEETRASSGVIWNSFKELEESELETVWREIPAPSFLIPLPKHYRASSSSLLDEDPSVAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6867 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcaggacgagtggcttcgcaacctgccgaccaccggtagcaacgcgggtatgaccatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgcgtagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6868 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQDEWLRNLPTTGSNAGMTIPIINKHGADEFRKELESAMRDSPSDEEVACLITDALWYFAQPVADSLNLKRLVLMTSSLFNFHALLCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSTAQWLDQQPPRSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6869 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgaccatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgcgtagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6870 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQTEWLRNLPTHGPGAGMTIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPRSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6871 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6872 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQTEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSTAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6873 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgaccaccggtagcaacgcgggtatgaccatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6874 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTTGSNAGMTIPIINKHGADEFRKELESAMRDSPSDEEVACLITDALWYFAQPVADSLNLKRLVLMTSSLFNFHALLCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6875 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgcgtagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtgtgcgaaggcgttccgatgatctttagcccgttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggatctgttggatcgaagcattgctcccggtggcagcagctacgagagcctggaacgcctggttagctatattagcagcctg

SEQ ID NO: 6876 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQTEWLRNLPTHGPGAGMRIPIINKHGADEFRKELESAMRDSPSDEEVACLITDALWYFAQPVADSLNLKRLVLMTSSLFNFHALLCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPRSVLYVGFGSQSEVDEKDFLEIARGLVDSKQSFLWRVRPGFVKGSEWIELLPDGFLGERGRIVKSCPQQEVLAHKAIGAFWTHGGWNGTMEAVCEGVPMIFSPFGLDQPLNARYMSEVLHVGVYLENGFERGEIVNAIRRVMVDPEGEVMRQNARKLKDLLDRSIAPGGSSYESLERLVSYISSL

SEQ ID NO: 6877 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcagaccgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctgctgtgcctgccgcagtttttagaggcgggctacctggataccgaagataaacatcgtccggaggaaccggtggtaggtttcccgatgctgaaggttaaagatatccgtcgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggtggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggatctggcggatcgaagcattgctcccggtggcagcagctacgagagcctggaacgcctggttagctatattagcagcctg

SEQ ID NO: 6878 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQTEWLRNLPTHGPGAGMRIPIINKHGADEFRKELESAMRDSPSDEEVACLITDALWYFAQPVADSLNLKRLVLMTSSLFNFHALLCLPQFLEAGYLDTEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVVEGVPMIFSDFGLDQPLNARYMSEVLHVGVYLENGFERGEIVNAIRRVMVDPEGEVMRQNARKLKDLADRSIAPGGSSYESLERLVSYISSL

SEQ ID NO: 6879 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagaagctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6880 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIEKLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6881 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggattcgagcattgctcccggtggcagcagctacgagagcctggaacgcctggttagctatattagcagcctg

SEQ ID NO: 6882 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDSSIAPGGSSYESLERLVSYISSL

SEQ ID NO: 6883 - DNA, 1371 bp, Artificial Sequence
  "Variant of ADP-beta-1,3-glucosyltransferase"
atgccaaacacaaccgaaaccaccaagcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6884 - protein, 457 aa, Artificial Sequence
  "Variant of ADP-beta-1,3-glucosyltransferase"
MPNTTETTKRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6885 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctgggggtggcagcagctacgagagcctggaacgcctggttagctatattagcagcctg

SEQ ID NO: 6886 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAGGGSSYESLERLVSYISSL

SEQ ID NO: 6887 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccattggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6888 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAHWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6889 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcgatagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6890 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASDSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6891 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttccagtttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6892 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFQFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6893 - DNA, 1371 bp, Artificial Sequence
  "Variant of ADP-beta-1,3-glucosyltransferase"
atgcagaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagttgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6894 - protein, 457 aa, Artificial Sequence
  "Variant of ADP-beta-1,3-glucosyltransferase"
MQNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6895 - DNA, 1371 bp, Artificial Sequence
  "Variant of ADP-beta-1,3-glucosyltransferase"
atgcataacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6896 - protein, 457 aa, Artificial Sequence
  "Variant of ADP-beta-1,3-glucosyltransferase"
MHNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6897 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtatcggcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6898 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVSAIRRVMVDPEGEVMRQNARKLKDKLDRSIAPGGSSYESLERLVSYISSL

SEQ ID NO: 6899 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctgcgggtggcagcagctacgagagcctggaacgcctggttagctatattagcagcctg

SEQ ID NO: 6900 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAAGGSSYESLERLVSYISSL

SEQ ID NO: 6901 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtcggttgaaggataagttggatcgaagcattgctcccggtggcagcagctacgagagcctggaacgcctggttagctatattagcagcctg

SEQ ID NO: 6902 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARRLKDKLDRSIAPGGSSYESLERLVSYISSL

SEQ ID NO: 6903 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagcgaaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6904 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEAKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6905 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacaaggcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgtccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6906 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHKADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6907 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggaggaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6908 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGAEEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6909 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagatcagcatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6910 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDQHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6911 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcagggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6912 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIAQGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6913 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgtttgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6914 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVVCLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6915 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagatggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6916 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESEMETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6917 - DNA, 1371 bp, Artificial Sequence
  "Variant of ADP-beta-1,3-glucosyltransferase"
atgaagaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6918 - protein, 457 aa, Artificial Sequence
  "Variant of ADP-beta-1,3-glucosyltransferase"
MKNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6919 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcccgagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6920 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASPSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6921 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttcaggagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6922 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFQELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6923 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcatggtggcagcagctacgagagcctggaacgcctggttagctatattagcagcctg

SEQ ID NO: 6924 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAHGGSSYESLERLVSYISSL

SEQ ID NO: 6925 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttacttgcgtgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6926 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVTCVITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6927 - DNA, 1371 bp, Artificial Sequence
  "Variant of ADP-beta-1,3-glucosyltransferase"
atgccaaacaataccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6928 - protein, 457 aa, Artificial Sequence
  "Variant of ADP-beta-1,3-glucosyltransferase"
MPNNTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6929 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgttgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6930 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPLLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6931 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggacaatcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6932 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDNQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6933 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcacgagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6934 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASTSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6935 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgtctagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6936 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPSSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6937 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggattatagcattgctcccggtggcagcagctacgagagcctggaacgcctggttagctatattagcagcctg

SEQ ID NO: 6938 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDYSIAPGGSSYESLERLVSYISSL

SEQ ID NO: 6939 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaatgatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6940 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDENDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6941 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcgtgagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6942 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASVSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6943 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttgcggagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6944 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFAELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6945 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattagtcccggtggcagcagctacgagagcctggaacgcctggttagctatattagcagcctg

SEQ ID NO: 6946 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSISPGGSSYESLERLVSYISSL

SEQ ID NO: 6947 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatggtagcattgctcccggtggcagcagctacgagagcctggaacgcctggttagctatattagcagcctg

SEQ ID NO: 6948 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDGSIAPGGSSYESLERLVSYISSL

SEQ ID NO: 6949 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcactagctacgagagcctggaacgcctggttagctatattagcagcctg

SEQ ID NO: 6950 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGTSYESLERLVSYISSL

SEQ ID NO: 6951 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatgatagcattgctcccggtggcagcagctacgagagcctggaacgcctggttagctatattagcagcctg

SEQ ID NO: 6952 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDDSIAPGGSSYESLERLVSYISSL

SEQ ID NO: 6953 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagccgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcataaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6954 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIEPLPDGFLGERGRIVKSCPQQEVLAHKAIGAFWTHGGWNGTMEAVAEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 6955 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggagtctagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6956 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELESSELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6957 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagttaaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6958 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEVKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6959 - DNA, 1371 bp, Artificial Sequence
  "Variant of ADP-beta-1,3-glucosyltransferase"
atgcggaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6960 - protein, 457 aa, Artificial Sequence
  "Variant of ADP-beta-1,3-glucosyltransferase"
MRNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6961 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgaggttctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcataaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6962 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIEVLPDGFLGERGRIVKSCPQQEVLAHKAIGAFWTHGGWNGTMEAVAEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 6963 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacataagccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6964 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHKPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6965 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagtctggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6966 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLESGFERGEIVNAIRRVMVDPEGEVMRQNARKLKDKLDRSIAPGGSSYESLERLVSYISSL

SEQ ID NO: 6967 - DNA, 1371 bp, Artificial Sequence
  "Variant of ADP-beta-1,3-glucosyltransferase"
atgccaatgacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6968 - protein, 457 aa, Artificial Sequence
  "Variant of ADP-beta-1,3-glucosyltransferase"
MPMTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6969 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgattctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6970 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPILKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6971 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtctgttgaaggataagttggatcgaagcattgctcccggtggcagcagctacgagagcctggaacgcctggttagctatattagcagcctg

SEQ ID NO: 6972 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARLLKDKLDRSIAPGGSSYESLERLVSYISSL

SEQ ID NO: 6973 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcggtcaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6974 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSGQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6975 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttcgtgagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6976 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFRELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6977 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggataatagcattgctcccggtggcagcagctacgagagcctggaacgcctggttagctatattagcagcctg

SEQ ID NO: 6978 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDNSIAPGGSSYESLERLVSYISSL

SEQ ID NO: 6979 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccggcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6980 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDRQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6981 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatgagagcattgctcccggtggcagcagctacgagagcctggaacgcctggttagctatattagcagcctg

SEQ ID NO: 6982 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDESIAPGGSSYESLERLVSYISSL

SEQ ID NO: 6983 - DNA, 1371 bp, Artificial Sequence
  "Variant of ADP-beta-1,3-glucosyltransferase"
atgccaaacacaaccgaaaccacctctcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6984 - protein, 457 aa, Artificial Sequence
  "Variant of ADP-beta-1,3-glucosyltransferase"
MPNTTETTSRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6985 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggctttagctacgagagcctggaacgcctggttagctatattagcagcctg

SEQ ID NO: 6986 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGFSYESLERLVSYISSL

SEQ ID NO: 6987 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgttacgctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6988 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVTLENGFERGEIVNAIRRVMVDPEGEVMRQNARKLKDKLDRSIAPGGSSYESLERLVSYISSL

SEQ ID NO: 6989 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgtctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtattttgaaggataagttggatcgaagcattgctcccggtggcagcagctacgagagcctggaacgcctggttagctatattagcagcctg

SEQ ID NO: 6990 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARILKDKLDRSIAPGGSSYESLERLVSYISSL

SEQ ID NO: 6991 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagccggggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6992 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASRGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6993 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtccgatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6994 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGPIVNAIRRVMVDPEGEVMRQNARKLKDKLDRSIAPGGSSYESLERLVSYISSL

SEQ ID NO: 6995 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggagtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 6996 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWSEIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 6997 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctgagggtggcagcagctacgagagcctggaacgcctggttagctatattagcagcctg

SEQ ID NO: 6998 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAEGGSSYESLERLVSYISSL

SEQ ID NO: 6999 - DNA, 1371 bp, Artificial Sequence
  "Variant of ADP-beta-1,3-glucosyltransferase"
atgccatttacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7000 - protein, 457 aa, Artificial Sequence
  "Variant of ADP-beta-1,3-glucosyltransferase"
MPFTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7001 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaaattctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7002 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEILHVGVYLENGFERGEIVNAIRRVMVDPEGEVMRQNARKLKDKLDRSIAPGGSSYESLERLVSYISSL

SEQ ID NO: 7003 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctaggggtggcagcagctacgagagcctggaacgcctggttagctatattagcagcctg

SEQ ID NO: 7004 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIARGGSSYESLERLVSYISSL

SEQ ID NO: 7005 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtttagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7006 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAFSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7007 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgaggtgggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7008 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFEVGEIVNAIRRVMVDPEGEVMRQNARKLKDKLDRSIAPGGSSYESLERLVSYISSL

SEQ ID NO: 7009 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagatttgcatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7010 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDLHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7011 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgacgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7012 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLTQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7013 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtagatgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7014 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVDAIRRVMVDPEGEVMRQNARKLKDKLDRSIAPGGSSYESLERLVSYISSL

SEQ ID NO: 7015 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgcgaatcccgatcattaacaagcactgtgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7016 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHCADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7017 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagatgcgcatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7018 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDAHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7019 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggacatgcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7020 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDMQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7021 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgagagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7022 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVESKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7023 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaatgagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7024 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFNELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7025 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaaggtaaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7026 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEGKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7027 - DNA, 1371 bp, Artificial Sequence
  "Variant of ADP-beta-1,3-glucosyltransferase"
atgatgaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7028 - protein, 457 aa, Artificial Sequence
  "Variant of ADP-beta-1,3-glucosyltransferase"
MMNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7029 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgttatttgaaggataagttggatcgaagcattgctcccggtggcagcagctacgagagcctggaacgcctggttagctatattagcagcctg

SEQ ID NO: 7030 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARYLKDKLDRSIAPGGSSYESLERLVSYISSL

SEQ ID NO: 7031 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaaccgtcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7032 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINRHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7033 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagactctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7034 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIETLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7035 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctgcagcgcctggttagctatattagcagcctg

SEQ ID NO: 7036 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLQRLVSYISSL

SEQ ID NO: 7037 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcgactgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7038 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGATEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7039 - DNA, 1371 bp, Artificial Sequence
  "Variant of ADP-beta-1,3-glucosyltransferase"
atgccacttacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7040 - protein, 457 aa, Artificial Sequence
  "Variant of ADP-beta-1,3-glucosyltransferase"
MPLTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7041 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaagcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7042 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIKRVMVDPEGEVMRQNARKLKDKLDRSIAPGGSSYESLERLVSYISSL

SEQ ID NO: 7043 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaacataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7044 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEHKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7045 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccttcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7046 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDLQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7047 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagatccgcatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7048 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDPHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7049 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtagtatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7050 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGSIVNAIRRVMVDPEGEVMRQNARKLKDKLDRSIAPGGSSYESLERLVSYISSL

SEQ ID NO: 7051 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgcctctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7052 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPPLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7053 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcatttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctgttggtggcagcagctacgagagcctggaacgcctggttagctatattagcagcctg

SEQ ID NO: 7054 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGIYLENGFERGEIVNAIRRVMVDPEGEVMRQNARKLKDKLDRSIAVGGSSYESLERLVSYISSL

SEQ ID NO: 7055 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagtctctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7056 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIESLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7057 - DNA, 1371 bp, Artificial Sequence
  "Variant of ADP-beta-1,3-glucosyltransferase"
atgccaaacacaaccgaaaccaccgctcgtcgtcgtcgtgttattctgtttccggttccgttcccgggccaccttaacccgatgttgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7058 - protein, 457 aa, Artificial Sequence
  "Variant of ADP-beta-1,3-glucosyltransferase"
MPNTTETTARRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7059 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacttctggttagctatattagcagcctg

SEQ ID NO: 7060 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLELLVSYISSL

SEQ ID NO: 7061 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggcctgctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7062 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGLLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7063 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgagcccggtggcagcagctacgagagcctggaacgcctggttagctatattagcagcctg

SEQ ID NO: 7064 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIEPGGSSYESLERLVSYISSL

SEQ ID NO: 7065 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggactgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7066 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWTEIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7067 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagcaggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7068 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESEQETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7069 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtggtttgaaggataagttggatcgaagcattgctcccggtggcagcagctacgagagcctggaacgcctggttagctatattagcagcctg

SEQ ID NO: 7070 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARGLKDKLDRSIAPGGSSYESLERLVSYISSL

SEQ ID NO: 7071 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagccgggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7072 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLEPGFERGEIVNAIRRVMVDPEGEVMRQNARKLKDKLDRSIAPGGSSYESLERLVSYISSL

SEQ ID NO: 7073 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgtatgatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7074 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRMILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7075 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggttcgagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7076 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGSRGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7077 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaaggcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7078 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVKAIRRVMVDPEGEVMRQNARKLKDKLDRSIAPGGSSYESLERLVSYISSL

SEQ ID NO: 7079 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggggcgaagcattgctcccggtggcagcagctacgagagcctggaacgcctggttagctatattagcagcctg

SEQ ID NO: 7080 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLGRSIAPGGSSYESLERLVSYISSL

SEQ ID NO: 7081 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtacgatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7082 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGTIVNAIRRVMVDPEGEVMRQNARKLKDKLDRSIAPGGSSYESLERLVSYISSL

SEQ ID NO: 7083 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagcagggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7084 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLEQGFERGEIVNAIRRVMVDPEGEVMRQNARKLKDKLDRSIAPGGSSYESLERLVSYISSL

SEQ ID NO: 7085 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatctgagcattgctcccggtggcagcagctacgagagcctggaacgcctggttagctatattagcagcctg

SEQ ID NO: 7086 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDLSIAPGGSSYESLERLVSYISSL

SEQ ID NO: 7087 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatgttagcattgctcccggtggcagcagctacgagagcctggaacgcctggttagctatattagcagcctg

SEQ ID NO: 7088 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDVSIAPGGSSYESLERLVSYISSL

SEQ ID NO: 7089 - DNA, 1371 bp, Artificial Sequence
  "Variant of ADP-beta-1,3-glucosyltransferase"
atgtttaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7090 - protein, 457 aa, Artificial Sequence
  "Variant of ADP-beta-1,3-glucosyltransferase"
MFNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7091 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctgaagcgcctggttagctatattagcagcctg

SEQ ID NO: 7092 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLKRLVSYISSL

SEQ ID NO: 7093 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgtcttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7094 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRLILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7095 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccggaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcacggctcccggtggcagcagctacgagagcctggaacgcctggttagctatattagcagcctg

SEQ ID NO: 7096 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPETSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSTAPGGSSYESLERLVSYISSL

SEQ ID NO: 7097 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattcatcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7098 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIHRVMVDPEGEVMRQNARKLKDKLDRSIAPGGSSYESLERLVSYISSL

SEQ ID NO: 7099 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtgttttgaaggataagttggatcgaagcattgctcccggtggcagcagctacgagagcctggaacgcctggttagctatattagcagcctg

SEQ ID NO: 7100 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARVLKDKLDRSIAPGGSSYESLERLVSYISSL

SEQ ID NO: 7101 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtactttgaaggataagttggatcgaagcattgctcccggtggcagcagctacgagagcctggaacgcctggttagctatattagcagcctg

SEQ ID NO: 7102 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARTLKDKLDRSIAPGGSSYESLERLVSYISSL

SEQ ID NO: 7103 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatttgccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7104 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHLPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7105 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcgtctgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7106 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGASEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7107 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgcttggggtggcagcagctacgagagcctggaacgcctggttagctatattagcagcctg

SEQ ID NO: 7108 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAWGGSSYESLERLVSYISSL

SEQ ID NO: 7109 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgttgtgctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7110 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVVLENGFERGEIVNAIRRVMVDPEGEVMRQNARKLKDKLDRSIAPGGSSYESLERLVSYISSL

SEQ ID NO: 7111 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgcctgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7112 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPPDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7113 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtcagttgaaggataagttggatcgaagcattgctcccggtggcagcagctacgagagcctggaacgcctggttagctatattagcagcctg

SEQ ID NO: 7114 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARQLKDKLDRSIAPGGSSYESLERLVSYISSL

SEQ ID NO: 7115 - DNA, 1371 bp, Artificial Sequence
  "Variant of ADP-beta-1,3-glucosyltransferase"
atgccaaacacaaccgaaaccaccatgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7116 - protein, 457 aa, Artificial Sequence
  "Variant of ADP-beta-1,3-glucosyltransferase"
MPNTTETTMRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7117 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattcggcccggtggcagcagctacgagagcctggaacgcctggttagctatattagcagcctg

SEQ ID NO: 7118 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIRPGGSSYESLERLVSYISSL

SEQ ID NO: 7119 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggagcgaagcattgctcccggtggcagcagctacgagagcctggaacgcctggttagctatattagcagcctg

SEQ ID NO: 7120 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLERSIAPGGSSYESLERLVSYISSL

SEQ ID NO: 7121 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattactcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7122 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAITRVMVDPEGEVMRQNARKLKDKLDRSIAPGGSSYESLERLVSYISSL

SEQ ID NO: 7123 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggaatgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7124 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWNEIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7125 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgttctttgaaggataagttggatcgaagcattgctcccggtggcagcagctacgagagcctggaacgcctggttagctatattagcagcctg

SEQ ID NO: 7126 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARSLKDKLDRSIAPGGSSYESLERLVSYISSL

SEQ ID NO: 7127 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgctagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7128 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVASKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7129 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacattcgccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7130 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHSPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7131 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaacgtgatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7132 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDERDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7133 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagcctctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7134 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIEPLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7135 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgggggacgaggaagttgcgtgcctgattaccgatgcgctgtggtacttcgcgcaaccggtggcggacagcctgaatctgaaacgtctggttctgatgaccagcagcctgtttaacttccacgcgctggtgtgtctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7136 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPGDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7137 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgactcaaaacgcgcgtaaattgaaggataagttggatcgaagcattgctcccggtggcagcagctacgagagcctggaacgcctggttagctatattagcagcctg

SEQ ID NO: 7138 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMTQNARKLKDKLDRSIAPGGSSYESLERLVSYISSL

SEQ ID NO: 7139 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctatgggtggcagcagctacgagagcctggaacgcctggttagctatattagcagcctg

SEQ ID NO: 7140 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAMGGSSYESLERLVSYISSL

SEQ ID NO: 7141 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgcgatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7142 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGAIVNAIRRVMVDPEGEVMRQNARKLKDKLDRSIAPGGSSYESLERLVSYISSL

SEQ ID NO: 7143 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagaggtgtgatttggaacagctttcatgagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7144 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASRGVIWNSFHELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7145 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggaagagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagctaaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7146 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQEEWLRNLPTHGPGAGMRIPIINKHGADEFRKELESAMRDSPSDEEVACLITDALWYFAQPVADSLNLKRLVLMTSSLFNFHALVCLPQFLELGYLDPEAKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7147 - DNA, 1371 bp, Artificial Sequence
  "Variant of ADP-beta-1,3-glucosyltransferase"
atgccaaactcgaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7148 - protein, 457 aa, Artificial Sequence
  "Variant of ADP-beta-1,3-glucosyltransferase"
MPNSTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7149 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaaggtctggttagctatattagcagcctg

SEQ ID NO: 7150 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLEGLVSYISSL

SEQ ID NO: 7151 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggaaagcctgaatctgaaacgtctggttctgatgaccagcagcctgtttaacttccacgcgctggtgtgcctgaatcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7152 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVAESLNLKRLVLMTSSLFNFHALVCLNQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7153 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggataagagcattgctcccggtggcagcagctacgagagcctggaacgcctggttagctatattagcagcctg

SEQ ID NO: 7154 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDKSIAPGGSSYESLERLVSYISSL

SEQ ID NO: 7155 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgaggctctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7156 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIEALPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7157 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttacttatattagcagcctg

SEQ ID NO: 7158 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVTYISSL

SEQ ID NO: 7159 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggaaggtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7160 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRKVMVDPEGEVMRQNARKLKDKLDRSIAPGGSSYESLERLVSYISSL

SEQ ID NO: 7161 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagtttgttgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7162 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVCCLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7163 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagcgcggagagcctggaacgcctggttagctatattagcagcctg

SEQ ID NO: 7164 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSAESLERLVSYISSL

SEQ ID NO: 7165 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgatatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7166 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGDIVNAIRRVMVDPEGEVMRQNARKLKDKLDRSIAPGGSSYESLERLVSYISSL

SEQ ID NO: 7167 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7168 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACVITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7169 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcgagagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7170 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASESSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7171 - DNA, 1371 bp, Artificial Sequence
  "Variant of ADP-beta-1,3-glucosyltransferase"
atggtgaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7172 - protein, 457 aa, Artificial Sequence
  "Variant of ADP-beta-1,3-glucosyltransferase"
MVNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7173 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaacctaaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7174 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEPKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7175 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaggggatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7176 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEGDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7177 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcacacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtgagttgaaggataagttggatcgaagcattgctcccggtggcagcagctacgagagcctggaacgcctggttagctatattagcagcctg

SEQ ID NO: 7178 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARELKDKLDRSIAPGGSSYESLERLVSYISSL

SEQ ID NO: 7179 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaacgtctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7180 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSERLHVGVYLENGFERGEIVNAIRRVMVDPEGEVMRQNARKLKDKLDRSIAPGGSSYESLERLVSYISSL

SEQ ID NO: 7181 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaccttttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7182 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQPFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7183 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcaagggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7184 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASKGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7185 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatattccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7186 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHIPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7187 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccggatgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7188 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPDDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7189 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatattagcattgctcccggtggcagcagctacgagagcctggaacgcctggttagctatattagcagcctg

SEQ ID NO: 7190 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDISIAPGGSSYESLERLVSYISSL

SEQ ID NO: 7191 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggaagagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggttcgatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7192 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQEEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGSIVNAIRRVMVDPEGEVMRQNARKLKDKLDRSIAPGGSSYESLERLVSYISSL

SEQ ID NO: 7193 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatgcgagcattgctcccggtggcagcagctacgagagcctggaacgcctggttagctatattagcagcctg

SEQ ID NO: 7194 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDASIAPGGSSYESLERLVSYISSL

SEQ ID NO: 7195 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctgagtaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7196 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLSNGFERGEIVNAIRRVMVDPEGEVMRQNARKLKDKLDRSIAPGGSSYESLERLVSYISSL

SEQ ID NO: 7197 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatgttagcagcctg

SEQ ID NO: 7198 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYVSSL

SEQ ID NO: 7199 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaatctctggttagctatattagcagcctg

SEQ ID NO: 7200 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLESLVSYISSL

SEQ ID NO: 7201 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaatttgaaggataagttggatcgaagcattgctcccggtggcagcagctacgagagcctggaacgcctggttagctatattagcagcctg

SEQ ID NO: 7202 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARNLKDKLDRSIAPGGSSYESLERLVSYISSL

SEQ ID NO: 7203 - DNA, 1371 bp, Artificial Sequence
  "Variant of ADP-beta-1,3-glucosyltransferase"
atgccaaacacaaccgaaaccaccggtcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7204 - protein, 457 aa, Artificial Sequence
  "Variant of ADP-beta-1,3-glucosyltransferase"
MPNTTETTGRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7205 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaagatgatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7206 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEDDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7207 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaaagtttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7208 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQKFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7209 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgaggggctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7210 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIEGLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7211 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcccgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7212 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFPQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7213 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtacagcagaggttttagcatcaccatttttcacaccaacttcaacgccccgaaaaccagcctttatccgcacttcagctttcgttttatcttggacaacgatccgcaggacgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatcaaacgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcaatagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtggcggaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7214 - protein, 457 aa, Artificial Sequence
  "Variant of ADP-beta-1,3-glucosyltransferase"
MPNTTETTVRRRRVILFPVPFPGHLNPMLQLANVLYSRGFSITIFHTNFNAPKTSLYPHFSFRFILDNDPQDEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIKRAYSHWQEAKPILDKMIEETRASSGVIWNSFKELEESELETVWREIPAPSFLLPLPKHYRASNSSLLDEDPSVAQWLDQQPPSSVLYVGFGSQSEVDEKDFLEIARGLVDSKQSFLWRVRPGFVKGSEWIELLPDGFLGERGRIVKSCPQQEVLAHKAIGAFWTHGGWNGTMEAVAEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7215 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttcccgttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagccgcgaagaggaaatgaacgcagcggcggaagaactgatacagctgtgtcgcaaccgcaacgcctacaag

SEQ ID NO: 7216 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRASREEEMNAAAEELIQLCRNRNAYK

SEQ ID NO: 7217 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtggaagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttaaagttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcgggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagccgcgaagaggaaatgaacgcagcggcggaagaactgatacagctgtgtcgcaaccgcaacgcctacaag

SEQ ID NO: 7218 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSGSIHLVELALPELPELPPHYHTTNGLPPHLNGTLHKALKMSAPNFSKILQNLKPDLVLYDFLQPWAEQVALEQGIPAVKVLTSGAALFSYFFNFLKRPGHEFPFPAIRLSKREQDKMREMFGTEPDEEDPLAPGNAGIMLMCTSRVIEAKYLDYCTELTNVKVVPVGPPFRDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRASREEEMNAAAEELIQLCRNRNAYK

SEQ ID NO: 7219 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtggaagcatccatctggttgagctggcgctgccagaattaccggaactgccaccacattaccatactaccaacggtttaccaccgcatctgaacgggaccctgcacaaggcactgaagatgagcgctcccaactttagcaagatccttatcaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattaccggccccactggtgagatcctgcgcgcgaaagtaagggacattagcctccgcctgagagcgagccgcgaggaggaaatgaacgcagcggcggaagaactgatacagctgtgtcgcaaccgcaacgcctacaag

SEQ ID NO: 7220 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSGSIHLVELALPELPELPPHYHTTNGLPPHLNGTLHKALKMSAPNFSKILINLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISLRLRASREEEMNAAAEELIQLCRNRNAYK

SEQ ID NO: 7221 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttcccgttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagccgcgatgaggaaatgaacgcagcggcggaagaactgatacagctgtgtcgcaaccgcaacgcctacaag

SEQ ID NO: 7222 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRASRDEEMNAAAEELIQLCRNRNAYK

SEQ ID NO: 7223 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaacagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattaccggccccactggtgagatcctgcgcgcgaaagtagcggacattagcaaacgcctgagagcgagccgcgaggaggaaatgaacgcagcggcggaagaactgatacagctgtgtcgcaaccgcaacgcctacaag

SEQ ID NO: 7224 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVADISKRLRASREEEMNAAAEELIQLCRNRNAYK

SEQ ID NO: 7225 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtggaagcatccatctggttgagctggcgctgccagaattaccggaactgccaccacattaccatactaccaacggtttaccaccgcatctgaacgggaccctgcacaaggcactgaagatgagcgctcccaactttagcaagatccttatcaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagccgcgaagaggaaatgaacgcagcggcggaagaactgatacagctgtgtcgcaaccgcaacgcctacaag

SEQ ID NO: 7226 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSGSIHLVELALPELPELPPHYHTTNGLPPHLNGTLHKALKMSAPNFSKILINLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRASREEEMNAAAEELIQLCRNRNAYK

SEQ ID NO: 7227 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtggaagcatccatctggttgagctggcgctgccagaattaccggaactgccaccacattaccatactaccaacggtttaccaccgcatctgaacgggaccctgcacaaggcactgaagatgagcgctcccaactttagcaagatccttcagaacctgaagccggacctggtcctttacgattttctgcaaccgtgggcagaacaggtcgccctagaacaggggatcccggctgttaaagttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7228 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSGSIHLVELALPELPELPPHYHTTNGLPPHLNGTLHKALKMSAPNFSKILQNLKPDLVLYDFLQPWAEQVALEQGIPAVKVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRARREEEMNAAAEELIQLCRNRNAYK

SEQ ID NO: 7229 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggttttgttatccatctcgttagtaccgctattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgatcccgtgggcagaacaagtcgccgaagaacagggcatcccggctgttccggttctaaccagtggtgcggcactgtttagctactttttcaacttcctgaagcgaccgggtcacgagtttccgtttccggcaatccgcctgtcgaagcgagaacaggataagatgagagagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattacgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7230 - protein, 450 aa, Artificial Sequence
  "Variant of ADP-beta-1,3-glucosyltransferase"
MHHHHEGVSGQTLRVLMFPWLALGHVNPFLRIAKQLADRGFVIHLVSTAINLESIKKRIPEKYSNSIHLVELHLPELPELPPHYHTTNGLPPHLNGTLHKALKMSAPNFSKILQNLKPDLVLYDFLIPWAEQVAEEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRARREEEMNAAAEELIQLCRNRNAYK

SEQ ID NO: 7231 - DNA, 1350 bp, Artificial Sequence
  "Variant of ADP-beta-1,3-glucosyltransferase"
atgcaccatcatcatgaaggcgtgagcggcctgaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgtcactgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgccgaagaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattacgggcgcgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7232 - protein, 450 aa, Artificial Sequence
  "Variant of ADP-beta-1,3-glucosyltransferase"
MHHHHEGVSGLTLRVLMFPWLALGHVNPFLRIAKQLADRGFVIYLVSTAINLESIKKRIPEKYSNSIHLVELSLPELPELPPHYHTTNGLPPHLNGTLHKALKMSAPNFSKILQNLKPDLVLYDFLQPWAEKVAEEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGATGEILRAKVRDISKRLRARREEEMNAAAEELIQLCRNRNAYK

SEQ ID NO: 7233 - DNA, 1350 bp, Artificial Sequence
  "Variant of ADP-beta-1,3-glucosyltransferase"
atgcaccatcatcatgaaggcgtgagcggcctgaccctgagagtactgatgtttccgtggcttgcgctgggtcatgttaacccgtttttgcgtatcgctaaacaactggccgatcgtggtcatgttatctatctcgttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcagccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaactggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattacgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7234 - protein, 450 aa, Artificial Sequence
  "Variant of ADP-beta-1,3-glucosyltransferase"
MHHHHEGVSGLTLRVLMFPWLALGHVNPFLRIAKQLADRGHVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEELAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRARREEEMNAAAEELIQLCRNRNAYK

SEQ ID NO: 7235 - DNA, 1350 bp, Artificial Sequence
  "Variant of ADP-beta-1,3-glucosyltransferase"
atgcaccatcatcatgaaggcgtgagcggcctgaccctgagagtactgatgtttccgtggcttgcgctgggtcatgttaacccgtttttgcgtatcgctaaacaactggccgatcgtggttttgttatctatctcgttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgatcccgtgggcagaaaaagtcgccgaagaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7236 - protein, 450 aa, Artificial Sequence
  "Variant of ADP-beta-1,3-glucosyltransferase"
MHHHHEGVSGLTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLIPWAEKVAEEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 7237 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcagccgtgggcagaaaaagtcgccgaagaacagggcatcccggctgttccggttctaaccagtggtgcggcactgtttagctactttttcaacttcctgaagcgaccgggtcacgagtttccgtttccggcaatccgcctgtcgaagcgagaacaggataagatgatagagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7238 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVAEEQGIPAVPVLTSGAALFSYFFNFLKRPGHEFPFPAIRLSKREQDKMIEMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRARREEEMNAAAEELIQLCRNRNAYK

SEQ ID NO: 7239 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggttttgttatctattatgttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattggcggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7240 - protein, 450 aa, Artificial Sequence
  "Variant of ADP-beta-1,3-glucosyltransferase"
MHHHHEGVSGQTLRVLMFPWLALGHVNPFLRIAKQLADRGFVIYYVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVIGGPTGEILRAKVRDISKRLRARREEEMNAAAEELIQLCRNRNAYK

SEQ ID NO: 7241 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgttggagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7242 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMLEMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRARREEEMNAAAEELIQLCRNRNAYK

SEQ ID NO: 7243 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggttttgttatctattatgttagtaccgctattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcagccgtgggcagaaaaagtcgccgaagaacagggcatcccggctgttccggttctaaccagtggtgcggcactgtttagctactttttcaacttcctgaagcgaccgggtcacgagtttccgtttccggcaatccgcctgtcgaagcgagaacaggataagatgttggagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7244 - protein, 450 aa, Artificial Sequence
  "Variant of ADP-beta-1,3-glucosyltransferase"
MHHHHEGVSGQTLRVLMFPWLALGHVNPFLRIAKQLADRGFVIYYVSTAINLESIKKRIPEKYSNSIHLVELHLPELPELPPHYHTTNGLPPHLNGTLHKALKMSAPNFSKILQNLKPDLVLYDFLQPWAEKVAEEQGIPAVPVLTSGAALFSYFFNFLKRPGHEFPFPAIRLSKREQDKMLEMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRARREEEMNAAAEELIQLCRNRNAYK

SEQ ID NO: 7245 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggttttgttatctattatgttagtaccgctattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgatcccgtgggcagaaaaagtcgccgaagaacagggcatcccggctgttccggttctaaccagtggtgcggcactgtttagctactttttcaacttcctgaagcgaccgggtcacgagtttccgtttccggcaatccgcctgtcgaagcgagaacaggataagatgagagagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattggcggcgcgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7246 - protein, 450 aa, Artificial Sequence
  "Variant of ADP-beta-1,3-glucosyltransferase"
MHHHHEGVSGQTLRVLMFPWLALGHVNPFLRIAKQLADRGFVIYYVSTAINLESIKKRIPEKYSNSIHLVELHLPELPELPPHYHTTNGLPPHLNGTLHKALKMSAPNFSKILQNLKPDLVLYDFLIPWAEKVAEEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVIGGATGEILRAKVRDISKRLRARREEEMNAAAEELIQLCRNRNAYK

SEQ ID NO: 7247 - DNA, 1350 bp, Artificial Sequence
  "Variant of ADP-beta-1,3-glucosyltransferase"
atgcaccatcatcatgaaggcgtgagcggcctgaccctgagagtactgatgtttccgtggcttgcgctgggtcatgttaacccgtttttgcgtatcgctaaacaactggccgatcgtggtcatgttatccatctcgttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgatcccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattggcggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7248 - protein, 450 aa, Artificial Sequence
  "Variant of ADP-beta-1,3-glucosyltransferase"
MHHHHEGVSGLTLRVLMFPWLALGHVNPFLRIAKQLADRGHVIHLVSTAINLESIKKRIPEKYSNSIHLVELALPELPELPPHYHTTNGLPPHLNGTLHKALKMSAPNFSKILQNLKPDLVLYDFLIPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVIGGPTGEILRAKVRDISKRLRARREEEMNAAAEELIQLCRNRNAYK

SEQ ID NO: 7249 - DNA, 1350 bp, Artificial Sequence
  "Variant of ADP-beta-1,3-glucosyltransferase"
atgcaccatcatcatgaaggcgtgagcggcctgaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgttggagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7250 - protein, 450 aa, Artificial Sequence
  "Variant of ADP-beta-1,3-glucosyltransferase"
MHHHHEGVSGLTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMLEMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 7251 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggttttgttatctattatgttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgatcccgtgggcagaaaaagtcgccgaagaacagggcatcccggctgttccggttctaaccagtggtgcggcactgtttagctactttttcaacttcctgaagcgaccgggtcacgagtttccgtttccggcaatccgcctgtcgaagcgagaacaggataagatgacagagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattggcggcgcgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7252 - protein, 450 aa, Artificial Sequence
  "Variant of ADP-beta-1,3-glucosyltransferase"
MHHHHEGVSGQTLRVLMFPWLALGHVNPFLRIAKQLADRGFVIYYVSTAINLESIKKRIPEKYSNSIHLVELALPELPELPPHYHTTNGLPPHLNGTLHKALKMSAPNFSKILQNLKPDLVLYDFLIPWAEKVAEEQGIPAVPVLTSGAALFSYFFNFLKRPGHEFPFPAIRLSKREQDKMTEMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVIGGATGEILRAKVRDISKRLRARREEEMNAAAEELIQLCRNRNAYK

SEQ ID NO: 7253 - DNA, 1350 bp, Artificial Sequence
  "Variant of ADP-beta-1,3-glucosyltransferase"
atgcaccatcatcatgaaggcgtgagcggcctgaccctgagagtactgatgtttccgtggcttgcgctgggtcatgttaacccgtttttgcgtatcgctaaacaactggccgatcgtggttttgttatctatctcgttagtaccgctattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgatcccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgagagagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattggcggcgcgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7254 - protein, 450 aa, Artificial Sequence
  "Variant of ADP-beta-1,3-glucosyltransferase"
MHHHHEGVSGLTLRVLMFPWLALGHVNPFLRIAKQLADRGFVIYLVSTAINLESIKKRIPEKYSNSIHLVELHLPELPELPPHYHTTNGLPPHLNGTLHKALKMSAPNFSKILQNLKPDLVLYDFLIPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVIGGATGEILRAKVRDISKRLRARREEEMNAAAEELIQLCRNRNAYK

SEQ ID NO: 7255 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgatcccgtgggcagaacaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattaccggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7256 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELHLPELPELPPHYHTTNGLPPHLNGTLHKALKMSAPNFSKILQNLKPDLVLYDFLIPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRARREEEMNAAAEELIQLCRNRNAYK

SEQ ID NO: 7257 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggttttgttatccattatgttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgatcccgtgggcagaaaaagtcgccgaagaacagacgatcccggctgttccggttctaaccagtggtgcggcactgtttagctactttttcaacttcctgaagcgaccgggtcacgagtttccgtttccggcaatccgcctgtcgaagcgagaacaggataagatgttggagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcgcgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7258 - protein, 450 aa, Artificial Sequence
  "Variant of ADP-beta-1,3-glucosyltransferase"
MHHHHEGVSGQTLRVLMFPWLALGHVNPFLRIAKQLADRGFVIHYVSTAINLESIKKRIPEKYSNSIHLVELALPELPELPPHYHTTNGLPPHLNGTLHKALKMSAPNFSKILQNLKPDLVLYDFLIPWAEKVAEEQTIPAVPVLTSGAALFSYFFNFLKRPGHEFPFPAIRLSKREQDKMLEMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGATGEILRAKVRDISKRLRARREEEMNAAAEELIQLCRNRNAYK

SEQ ID NO: 7259 - DNA, 1350 bp, Artificial Sequence
  "Variant of ADP-beta-1,3-glucosyltransferase"
atgcaccatcatcatgaaggcgtgagcggcctgaccctgagagtactgatgtttccgtggcttgcgctgggtcatgttaacccgtttttgcgtatcgctaaacaactggccgatcgtggtcatgttatctattatgttagtaccgctattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgatcccgtgggcagaacaagtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaactggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattggcggcgcgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7260 - protein, 450 aa, Artificial Sequence
  "Variant of ADP-beta-1,3-glucosyltransferase"
MHHHHEGVSGLTLRVLMFPWLALGHVNPFLRIAKQLADRGHVIYYVSTAINLESIKKRIPEKYSNSIHLVELHLPELPELPPHYHTTNGLPPHLNGTLHKALKMSAPNFSKILQNLKPDLVLYDFLIPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEELAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVIGGATGEILRAKVRDISKRLRARREEEMNAAAEELIQLCRNRNAYK

SEQ ID NO: 7261 - DNA, 1350 bp, Artificial Sequence
  "Variant of ADP-beta-1,3-glucosyltransferase"
atgcaccatcatcatgaaggcgtgagcggcctgaccctgagagtactgatgtttccgtggcttgcgctgggtcatgttaacccgtttttgcgtatcgctaaacaactggccgatcgtggttttgttatctatctcgttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgatcccgtgggcagaaaaagtcgccgaagaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7262 - protein, 450 aa, Artificial Sequence
  "Variant of ADP-beta-1,3-glucosyltransferase"
MHHHHEGVSGLTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLIPWAEKVAEEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRARREEEMNAAAEELIQLCRNRNAYK

SEQ ID NO: 7263 - DNA, 1350 bp, Artificial Sequence
  "Variant of ADP-beta-1,3-glucosyltransferase"
atgcaccatcatcatgaaggcgtgagcggcctgaccctgagagtactgatgtttccgtggcttgcgctgggtcatgttaacccgtttttgcgtatcgctaaacaactggccgatcgtggttttgttatctattatgttagtaccgctattaacctcgaaagcatcaaaaagagaatcccggagaaatacagtaatagcatccatctggttgagctggcactgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgatcccgtgggcagaaaaagtcgccgaagaacagacgatcccggctgttccggttctaaccagtggtgcggcactgtttagctactttttcaacttcctgaagcgaccgggtcacgagtttccgtttccggcaatccgcctgtcgaagcgagaacaggataagatgacagagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7264 - protein, 450 aa, Artificial Sequence
  "Variant of ADP-beta-1,3-glucosyltransferase"
MHHHHEGVSGLTLRVLMFPWLALGHVNPFLRIAKQLADRGFVIYYVSTAINLESIKKRIPEKYSNSIHLVELALPELPELPPHYHTTNGLPPHLNGTLHKALKMSAPNFSKILQNLKPDLVLYDFLIPWAEKVAEEQTIPAVPVLTSGAALFSYFFNFLKRPGHEFPFPAIRLSKREQDKMTEMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRARREEEMNAAAEELIQLCRNRNAYK

SEQ ID NO: 7265 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggttttgttatccattatgttagtaccgctattaacctcgaaagcatcaaaaagagaatcccggagaaatacagtaatagcatccatctggttgagctggcactgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgatcccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaactggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7266 - protein, 450 aa, Artificial Sequence
  "Variant of ADP-beta-1,3-glucosyltransferase"
MHHHHEGVSGQTLRVLMFPWLALGHVNPFLRIAKQLADRGFVIHYVSTAINLESIKKRIPEKYSNSIHLVELALPELPELPPHYHTTNGLPPHLNGTLHKALKMSAPNFSKILQNLKPDLVLYDFLIPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEELAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRARREEEMNAAAEELIQLCRNRNAYK

SEQ ID NO: 7267 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggttttgttatccatctcgttagtaccgctattaacctcgaaagcatcaaaaagagaatcccggagaaatacagtaatagcatccatctggttgagctgtcactgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgccgaagaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattggcggcgcgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7268 - protein, 450 aa, Artificial Sequence
  "Variant of ADP-beta-1,3-glucosyltransferase"
MHHHHEGVSGQTLRVLMFPWLALGHVNPFLRIAKQLADRGFVIHLVSTAINLESIKKRIPEKYSNSIHLVELSLPELPELPPHYHTTNGLPPHLNGTLHKALKMSAPNFSKILQNLKPDLVLYDFLQPWAEKVAEEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVIGGATGEILRAKVRDISKRLRARREEEMNAAAEELIQLCRNRNAYK

SEQ ID NO: 7269 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcagccgtgggcagaaaaagtcgccgaagaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattggcggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7270 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVAEEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVIGGPTGEILRAKVRDISKRLRARREEEMNAAAEELIQLCRNRNAYK

SEQ ID NO: 7271 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtcatgttatctatctcgttagtaccgctattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcagccgtgggcagaaaaagtcgccgaagaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattggcggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7272 - protein, 450 aa, Artificial Sequence
  "Variant of ADP-beta-1,3-glucosyltransferase"
MHHHHEGVSGQTLRVLMFPWLALGHVNPFLRIAKQLADRGHVIYLVSTAINLESIKKRIPEKYSNSIHLVELHLPELPELPPHYHTTNGLPPHLNGTLHKALKMSAPNFSKILQNLKPDLVLYDFLQPWAEKVAEEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVIGGPTGEILRAKVRDISKRLRARREEEMNAAAEELIQLCRNRNAYK

SEQ ID NO: 7273 - DNA, 1350 bp, Artificial Sequence
  "Variant of ADP-beta-1,3-glucosyltransferase"
atgcaccatcatcatgaaggcgtgagcggcctgaccctgagagtactgatgtttccgtggcttgcgctgggtcatgttaacccgtttttgcgtatcgctaaacaactggccgatcgtggttttgttatccatctcgttagtaccgctattaacctcgaaagcatcaaaaagagaatcccggagaaatacagtaatagcatccatctggttgagctgtcactgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgatcccgtgggcagaaaaagtcgccgaagaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattggcggcgcgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7274 - protein, 450 aa, Artificial Sequence
  "Variant of ADP-beta-1,3-glucosyltransferase"
MHHHHEGVSGLTLRVLMFPWLALGHVNPFLRIAKQLADRGFVIHLVSTAINLESIKKRIPEKYSNSIHLVELSLPELPELPPHYHTTNGLPPHLNGTLHKALKMSAPNFSKILQNLKPDLVLYDFLIPWAEKVAEEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVIGGATGEILRAKVRDISKRLRARREEEMNAAAEELIQLCRNRNAYK

SEQ ID NO: 7275 - DNA, 1350 bp, Artificial Sequence
  "Variant of ADP-beta-1,3-glucosyltransferase"
atgcaccatcatcatgaaggcgtgagcggcctgaccctgagagtactgatgtttccgtggcttgcgctgggtcatgttaacccgtttttgcgtatcgctaaacaactggccgatcgtggttttgttatccatctcgttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgatcccgtgggcagaacaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7276 - protein, 450 aa, Artificial Sequence
  "Variant of ADP-beta-1,3-glucosyltransferase"
MHHHHEGVSGLTLRVLMFPWLALGHVNPFLRIAKQLADRGFVIHLVSTAINLESIKKRIPEKYSNSIHLVELALPELPELPPHYHTTNGLPPHLNGTLHKALKMSAPNFSKILQNLKPDLVLYDFLIPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRARREEEMNAAAEELIQLCRNRNAYK

SEQ ID NO: 7277 - DNA, 1350 bp, Artificial Sequence
  "Variant of ADP-beta-1,3-glucosyltransferase"
atgcaccatcatcatgaaggcgtgagcggcctgaccctgagagtactgatgtttccgtggcttgcgctgggtcatgttaacccgtttttgcgtatcgctaaacaactggccgatcgtggttttgttatccatctcgttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcagccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaactggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattggcggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7278 - protein, 450 aa, Artificial Sequence
  "Variant of ADP-beta-1,3-glucosyltransferase"
MHHHHEGVSGLTLRVLMFPWLALGHVNPFLRIAKQLADRGFVIHLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEELAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVIGGPTGEILRAKVRDISKRLRARREEEMNAAAEELIQLCRNRNAYK

SEQ ID NO: 7279 - DNA, 1350 bp, Artificial Sequence
  "Variant of ADP-beta-1,3-glucosyltransferase"
atgcaccatcatcatgaaggcgtgagcggcctgaccctgagagtactgatgtttccgtggcttgcgctgggtcatgttaacccgtttttgcgtatcgctaaacaactggccgatcgtggttttgttatccatctcgttagtaccgctattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgatcccgtgggcagaaaaagtcgccgaagaacagggcatcccggctgttccggttctaaccagtggtgcggcactgtttagctactttttcaacttcctgaagcgaccgggtcacgagtttccgtttccggcaatccgcctgtcgaagcgagaacaggataagatgagagagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7280 - protein, 450 aa, Artificial Sequence
  "Variant of ADP-beta-1,3-glucosyltransferase"
MHHHHEGVSGLTLRVLMFPWLALGHVNPFLRIAKQLADRGFVIHLVSTAINLESIKKRIPEKYSNSIHLVELHLPELPELPPHYHTTNGLPPHLNGTLHKALKMSAPNFSKILQNLKPDLVLYDFLIPWAEKVAEEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRARREEEMNAAAEELIQLCRNRNAYK

SEQ ID NO: 7281 - DNA, 1350 bp, Artificial Sequence
  "Variant of ADP-beta-1,3-glucosyltransferase"
atgcaccatcatcatgaaggcgtgagcggcctgaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgatcccgtgggcagaaaaagtcgcccttgaacaggggatcccggctgttccggttctaaccagtggtgcggcactgtttagctactttttcaacttcctgaagcgaccgggtcacgagtttccgtttccggcaatccgcctgtcgaagcgagaacaggataagatgacagagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7282 - protein, 450 aa, Artificial Sequence
  "Variant of ADP-beta-1,3-glucosyltransferase"
MHHHHEGVSGLTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLIPWAEKVALEQGIPAVPVLTSGAALFSYFFNFLKRPGHEFPFPAIRLSKREQDKMTEMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRARREEEMNAAAEELIQLCRNRNAYK

SEQ ID NO: 7283 - DNA, 1350 bp, Artificial Sequence
  "Variant of ADP-beta-1,3-glucosyltransferase"
atgcaccatcatcatgaaggcgtgagcggcctgaccctgagagtactgatgtttccgtggcttgcgctgggtcatgttaacccgtttttgcgtatcgctaaacaactggccgatcgtggttttgttatctatctcgttagtaccgctattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgatcccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaactggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattggcggcgcgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7284 - protein, 450 aa, Artificial Sequence
  "Variant of ADP-beta-1,3-glucosyltransferase"
MHHHHEGVSGLTLRVLMFPWLALGHVNPFLRIAKQLADRGFVIYLVSTAINLESIKKRIPEKYSNSIHLVELHLPELPELPPHYHTTNGLPPHLNGTLHKALKMSAPNFSKILQNLKPDLVLYDFLIPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEELAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVIGGATGEILRAKVRDISKRLRARREEEMNAAAEELIQLCRNRNAYK

SEQ ID NO: 7285 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtcatgttatccattatgttagtaccgctattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgatcccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaactggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7286 - protein, 450 aa, Artificial Sequence
  "Variant of ADP-beta-1,3-glucosyltransferase"
MHHHHEGVSGQTLRVLMFPWLALGHVNPFLRIAKQLADRGHVIHYVSTAINLESIKKRIPEKYSNSIHLVELHLPELPELPPHYHTTNGLPPHLNGTLHKALKMSAPNFSKILQNLKPDLVLYDFLIPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEELAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRARREEEMNAAAEELIQLCRNRNAYK

SEQ ID NO: 7287 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtcatgttatctattatgttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgatcccgtgggcagaaaaagtcgccgaagaacagggcatcccggctgttccagttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaactggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7288 - protein, 450 aa, Artificial Sequence
  "Variant of ADP-beta-1,3-glucosyltransferase"
MHHHHEGVSGQTLRVLMFPWLALGHVNPFLRIAKQLADRGHVIYYVSTAINLESIKKRIPEKYSNSIHLVELALPELPELPPHYHTTNGLPPHLNGTLHKALKMSAPNFSKILQNLKPDLVLYDFLIPWAEKVAEEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEELAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 7289 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggttttgttatctattatgttagtaccgctattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7290 - protein, 450 aa, Artificial Sequence
  "Variant of ADP-beta-1,3-glucosyltransferase"
MHHHHEGVSGQTLRVLMFPWLALGHVNPFLRIAKQLADRGFVIYYVSTAINLESIKKRIPEKYSNSIHLVELHLPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRARREEEMNAAAEELIQLCRNRNAYK

SEQ ID NO: 7291 - DNA, 1350 bp, Artificial Sequence
  "Variant of ADP-beta-1,3-glucosyltransferase"
atgcaccatcatcatgaaggcgtgagcggcctgaccctgagagtactgatgtttccgtggcttgcgctgggtcatgttaacccgtttttgcgtatcgctaaacaactggccgatcgtggttttgttatctattatgttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcagccgtgggcagaacaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgagagagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattggcggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7292 - protein, 450 aa, Artificial Sequence
  "Variant of ADP-beta-1,3-glucosyltransferase"
MHHHHEGVSGLTLRVLMFPWLALGHVNPFLRIAKQLADRGFVIYYVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVIGGPTGEILRAKVRDISKRLRARREEEMNAAAEELIQLCRNRNAYK

SEQ ID NO: 7293 - DNA, 1350 bp, Artificial Sequence
  "Variant of ADP-beta-1,3-glucosyltransferase"
atgcaccatcatcatgaaggcgtgagcggcctgaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcagccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattacgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7294 - protein, 450 aa, Artificial Sequence
  "Variant of ADP-beta-1,3-glucosyltransferase"
MHHHHEGVSGLTLRVLMFPWLALGHVNPFLRIAKQLADRGFVIYLVSTAINLESIKKRIPEKYSNSIHLVELHLPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRARREEEMNAAAEELIQLCRNRNAYK

SEQ ID NO: 7295 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggttttgttatctattatgttagtaccgctattaacctcgaaagcatcaaaaagagaatcccggagaaatacagtaatagcatccatctggttgagctggcactgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgatcccgtgggcagaaaaagtcgcccttgaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattacgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7296 - protein, 450 aa, Artificial Sequence
  "Variant of ADP-beta-1,3-glucosyltransferase"
MHHHHEGVSGQTLRVLMFPWLALGHVNPFLRIAKQLADRGFVIYYVSTAINLESIKKRIPEKYSNSIHLVELALPELPELPPHYHTTNGLPPHLNGTLHKALKMSAPNFSKILQNLKPDLVLYDFLIPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRARREEEMNAAAEELIQLCRNRNAYK

SEQ ID NO: 7297 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggttttgttatctatctcgttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattggcggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7298 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVIGGPTGEILRAKVRDISKRLRARREEEMNAAAEELIQLCRNRNAYK

SEQ ID NO: 7299 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggttttgttatctattatgttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcagccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattacgggcgcgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7300 - protein, 450 aa, Artificial Sequence
  "Variant of ADP-beta-1,3-glucosyltransferase"
MHHHHEGVSGQTLRVLMFPWLALGHVNPFLRIAKQLADRGFVIYYVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGATGEILRAKVRDISKRLRARREEEMNAAAEELIQLCRNRNAYK

SEQ ID NO: 7301 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgatcccgtgggcagaaaaagtcgcccttgaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7302 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELHLPELPELPPHYHTTNGLPPHLNGTLHKALKMSAPNFSKILQNLKPDLVLYDFLIPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRARREEEMNAAAEELIQLCRNRNAYK

SEQ ID NO: 7303 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggttttgttatccattatgttagtaccgctattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgccgaagaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattggcggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7304 - protein, 450 aa, Artificial Sequence
  "Variant of ADP-beta-1,3-glucosyltransferase"
MHHHHEGVSGQTLRVLMFPWLALGHVNPFLRIAKQLADRGFVIHYVSTAINLESIKKRIPEKYSNSIHLVELHLPELPELPPHYHTTNGLPPHLNGTLHKALKMSAPNFSKILQNLKPDLVLYDFLQPWAEKVAEEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVIGGPTGEILRAKVRDISKRLRARREEEMNAAAEELIQLCRNRNAYK

SEQ ID NO: 7305 - DNA, 1350 bp, Artificial Sequence
  "Variant of ADP-beta-1,3-glucosyltransferase"
atgcaccatcatcatgaaggcgtgagcggcctgaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgatcccgtgggcagaaaaagtcgcccttgaacagacgatcccggctgttccggttctaaccagtggtgcggcactgtttagctactttttcaacttcctgaagcgaccgggtcacgagtttccgtttccggcaatccgcctgtcgaagcgagaacaggataagatgttggagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattacgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7306 - protein, 450 aa, Artificial Sequence
  "Variant of ADP-beta-1,3-glucosyltransferase"
MHHHHEGVSGLTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLIPWAEKVALEQTIPAVPVLTSGAALFSYFFNFLKRPGHEFPFPAIRLSKREQDKMLEMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRARREEEMNAAAEELIQLCRNRNAYK

SEQ ID NO: 7307 - DNA, 1350 bp, Artificial Sequence
  "Variant of ADP-beta-1,3-glucosyltransferase"
atgcaccatcatcatgaaggcgtgagcggcctgaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgtcactgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgatcccgtgggcagaaaaagtcgccgaagaacagggcatcccggctgttccggttctaaccagtggtgcggcactgtttagctactttttcaacttcctgaagcgaccgggtcacgagtttccgtttccggcaatccgcctgtcgaagcgagaacaggataagatgttggagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaactggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7308 - protein, 450 aa, Artificial Sequence
  "Variant of ADP-beta-1,3-glucosyltransferase"
MHHHHEGVSGLTLRVLMFPWLALGHVNPFLRIAKQLADRGFVIYLVSTAINLESIKKRIPEKYSNSIHLVELSLPELPELPPHYHTTNGLPPHLNGTLHKALKMSAPNFSKILQNLKPDLVLYDFLIPWAEKVAEEQGIPAVPVLTSGAALFSYFFNFLKRPGHEFPFPAIRLSKREQDKMLEMFGTEPDEEDPLAPGNAGIMLMCTSRVIEAKYLDYCTELTNVKVVPVGPPFQDPMTEDIDDKELIDWLDTKPENSVVYVSFGSEYFLSREDMEELAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRARREEEMNAAAEELIQLCRNRNAYK

SEQ ID NO: 7309 - DNA, 1350 bp, Artificial Sequence
  "Variant of ADP-beta-1,3-glucosyltransferase"
atgcaccatcatcatgaaggcgtgagcggcctgaccctgagagtactgatgtttccgtggcttgcgctgggtcatgttaacccgtttttgcgtatcgctaaacaactggccgatcgtggtcatgttatctattatgttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgatcccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaactggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattggcggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7310 - protein, 450 aa, Artificial Sequence
  "Variant of ADP-beta-1,3-glucosyltransferase"
MHHHHEGVSGLTLRVLMFPWLALGHVNPFLRIAKQLADRGHVIYYVSTAINLESIKKRIPEKYSNSIHLVELALPELPELPPHYHTTNGLPPHLNGTLHKALKMSAPNFSKILQNLKPDLVLYDFLIPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEELAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVIGGPTGEILRAKVRDISKRLRARREEEMNAAAEELIQLCRNRNAYK

SEQ ID NO: 7311 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggttttgttatctattatgttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgatcccgtgggcagaaaaagtcgccgaagaacagggcatcccggctgttccggttctaaccagtggtgcggcactgtttagctactttttcaacttcctgaagcgaccgggtcacgagtttccgtttccggcaatccgcctgtcgaagcgagaacaggataagatgttggagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7312 - protein, 450 aa, Artificial Sequence
  "Variant of ADP-beta-1,3-glucosyltransferase"
MHHHHEGVSGQTLRVLMFPWLALGHVNPFLRIAKQLADRGFVIYYVSTAINLESIKKRIPEKYSNSIHLVELALPELPELPPHYHTTNGLPPHLNGTLHKALKMSAPNFSKILQNLKPDLVLYDFLIPWAEKVAEEQGIPAVPVLTSGAALFSYFFNFLKRPGHEFPFPAIRLSKREQDKMLEMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRARREEEMNAAAEELIQLCRNRNAYK

SEQ ID NO: 7313 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggttttgttatccatctcgttagtaccgctattaacctcgaaagcatcaaaaagagaatcccggagaaatacagtaatagcatccatctggttgagctgtcactgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgatcccgtgggcagaacaagtcgccgaagaacagggcatcccggctgttccggttctaaccagtggtgcggcactgtttagctactttttcaacttcctgaagcgaccgggtcacgagtttccgtttccggcaatccgcctgtcgaagcgagaacaggataagatgttggagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaactggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattggcggcgcgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7314 - protein, 450 aa, Artificial Sequence
  "Variant of ADP-beta-1,3-glucosyltransferase"
MHHHHEGVSGQTLRVLMFPWLALGHVNPFLRIAKQLADRGFVIHLVSTAINLESIKKRIPEKYSNSIHLVELSLPELPELPPHYHTTNGLPPHLNGTLHKALKMSAPNFSKILQNLKPDLVLYDFLIPWAEQVAEEQGIPAVPVLTSGAALFSYFFNFLKRPGHEFPFPAIRLSKREQDKMLEMFGTEPDEEDPLAPGNAGIMLMCTSRVIEAKYLDYCTELTNVKVVPVGPPFQDPMTEDIDDKELIDWLDTKPENSVVYVSFGSEYFLSREDMEELAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVIGGATGEILRAKVRDISKRLRARREEEMNAAAEELIQLCRNRNAYK

SEQ ID NO: 7315 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgatcccgtgggcagaacaagtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7316 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLIPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRARREEEMNAAAEELIQLCRNRNAYK

SEQ ID NO: 7317 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggttttgttatctatctcgttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcagccgtgggcagaaaaagtcgccgaagaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7318 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVAEEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRARREEEMNAAAEELIQLCRNRNAYK

SEQ ID NO: 7319 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggttttgttatctattatgttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgatcccgtgggcagaacaagtcgccgaagaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7320 - protein, 450 aa, Artificial Sequence
  "Variant of ADP-beta-1,3-glucosyltransferase"
MHHHHEGVSGQTLRVLMFPWLALGHVNPFLRIAKQLADRGFVIYYVSTAINLESIKKRIPEKYSNSIHLVELALPELPELPPHYHTTNGLPPHLNGTLHKALKMSAPNFSKILQNLKPDLVLYDFLIPWAEQVAEEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRARREEEMNAAAEELIQLCRNRNAYK

SEQ ID NO: 7321 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggttttgttatctatctcgttagtaccgctattaacctcgaaagcatcaaaaagagaatcccggagaaatacagtaatagcatccatctggttgagctggcactgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgatcccgtgggcagaaaaagtcgccgaagaacagggcatcccggctgttccggttctaaccagtggtgcggcactgtttagctactttttcaacttcctgaagcgaccgggtcacgagtttccgtttccggcaatccgcctgtcgaagcgagaacaggataagatgatagagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattggcggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7322 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLIPWAEKVAEEQGIPAVPVLTSGAALFSYFFNFLKRPGHEFPFPAIRLSKREQDKMIEMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVIGGPTGEILRAKVRDISKRLRARREEEMNAAAEELIQLCRNRNAYK

SEQ ID NO: 7323 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7324 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 7325 - DNA, 1350 bp, Artificial Sequence
  "Variant of ADP-beta-1,3-glucosyltransferase"
atgcaccatcatcatgaaggcgtgagcggcctgaccctgagagtactgatgtttccgtggcttgcgctgggtcatgttaacccgtttttgcgtatcgctaaacaactggccgatcgtggttttgttatctattatgttagtaccgctattaacctcgaaagcatcaaaaagagaatcccggagaaatacagtaatagcatccatctggttgagctgcatctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgatcccgtgggcagaacaagtcgccgaagaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7326 - protein, 450 aa, Artificial Sequence
  "Variant of ADP-beta-1,3-glucosyltransferase"
MHHHHEGVSGLTLRVLMFPWLALGHVNPFLRIAKQLADRGFVIYYVSTAINLESIKKRIPEKYSNSIHLVELHLPELPELPPHYHTTNGLPPHLNGTLHKALKMSAPNFSKILQNLKPDLVLYDFLIPWAEQVAEEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRARREEEMNAAAEELIQLCRNRNAYK

SEQ ID NO: 7327 - DNA, 1350 bp, Artificial Sequence
  "Variant of ADP-beta-1,3-glucosyltransferase"
atgcaccatcatcatgaaggcgtgagcggcctgaccctgagagtactgatgtttccgtggcttgcgctgggtcatgttaacccgtttttgcgtatcgctaaacaactggccgatcgtggtcatgttatccatctcgttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgatcccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgagagagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaactggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7328 - protein, 450 aa, Artificial Sequence
  "Variant of ADP-beta-1,3-glucosyltransferase"
MHHHHEGVSGLTLRVLMFPWLALGHVNPFLRIAKQLADRGHVIHLVSTAINLESIKKRIPEKYSNSIHLVELALPELPELPPHYHTTNGLPPHLNGTLHKALKMSAPNFSKILQNLKPDLVLYDFLIPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEELAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 7329 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggttttgttatctattatgttagtaccgctattaacctcgaaagcatcaaaaagagaatcccggagaaatacagtaatagcatccatctggttgagctgtcactgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaactggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattggcggcgcgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7330 - protein, 450 aa, Artificial Sequence
  "Variant of ADP-beta-1,3-glucosyltransferase"
MHHHHEGVSGQTLRVLMFPWLALGHVNPFLRIAKQLADRGFVIYYVSTAINLESIKKRIPEKYSNSIHLVELSLPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEELAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVIGGATGEILRAKVRDISKRLRARREEEMNAAAEELIQLCRNRNAYK

SEQ ID NO: 7331 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggttttgttatctatctcgttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgatcccgtgggcagaaaaagtcgccgaagaacagggcatcccggctgttccggttctaaccagtggtgcggcactgtttagctactttttcaacttcctgaagcgaccgggtcacgagtttccgtttccggcaatccgcctgtcgaagcgagaacaggataagatgttggagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7332 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLIPWAEKVAEEQGIPAVPVLTSGAALFSYFFNFLKRPGHEFPFPAIRLSKREQDKMLEMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRARREEEMNAAAEELIQLCRNRNAYK

SEQ ID NO: 7333 - DNA, 1350 bp, Artificial Sequence
  "Variant of ADP-beta-1,3-glucosyltransferase"
atgcaccatcatcatgaaggcgtgagcggcctgaccctgagagtactgatgtttccgtggcttgcgctgggtcatgttaacccgtttttgcgtatcgctaaacaactggccgatcgtggttttgttatccattatgttagtaccgctattaacctcgaaagcatcaaaaagagaatcccggagaaatacagtaatagcatccatctggttgagctggcactgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgatcccgtgggcagaacaagtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattacgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7334 - protein, 450 aa, Artificial Sequence
  "Variant of ADP-beta-1,3-glucosyltransferase"
MHHHHEGVSGLTLRVLMFPWLALGHVNPFLRIAKQLADRGFVIHYVSTAINLESIKKRIPEKYSNSIHLVELALPELPELPPHYHTTNGLPPHLNGTLHKALKMSAPNFSKILQNLKPDLVLYDFLIPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRARREEEMNAAAEELIQLCRNRNAYK

SEQ ID NO: 7335 - DNA, 1350 bp, Artificial Sequence
  "Variant of ADP-beta-1,3-glucosyltransferase"
atgcaccatcatcatgaaggcgtgagcggcctgaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcactgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgatcccgtgggcagaaaaagtcgccgaagaacagggcatcccggctgttccggttctaaccagtggtgcggcactgtttagctactttttcaacttcctgaagcgaccgggtcacgagtttccgtttccggcaatccgcctgtcgaagcgagaacaggataagatgttggagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7336 - protein, 450 aa, Artificial Sequence
  "Variant of ADP-beta-1,3-glucosyltransferase"
MHHHHEGVSGLTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLIPWAEKVAEEQGIPAVPVLTSGAALFSYFFNFLKRPGHEFPFPAIRLSKREQDKMLEMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRARREEEMNAAAEELIQLCRNRNAYK

SEQ ID NO: 7337 - DNA, 1350 bp, Artificial Sequence
  "Variant of ADP-beta-1,3-glucosyltransferase"
atgcaccatcatcatgaaggcgtgagcggcctgaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcagccgtgggcagaaaaagtcgccgaagaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattggcggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7338 - protein, 450 aa, Artificial Sequence
  "Variant of ADP-beta-1,3-glucosyltransferase"
MHHHHEGVSGLTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVAEEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVIGGPTGEILRAKVRDISKRLRARREEEMNAAAEELIQLCRNRNAYK

SEQ ID NO: 7339 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaaacgaccgggtgaagagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcggcgaactgaccaatgtaaaagtggttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccatcgggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaacgcagcggcggaagaactgatacagctgtgtcgcaaccgcaacgcccacaag

SEQ ID NO: 7340 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGEEFPFPAIRLSKREQDKMREMFGTEPDEEDPLAPGNAGIMLMCTSRVIEAKYLDYCGELTNVKVVPVGPPFQDPMTEDIDDKELIDWLDTKPENSVVYVSFGSEYFLSREDMEEVAFGLELSNVNFIWVARFPKGEEQNLEDVLPSGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRARREEEMNAAAEELIQLCRNRNAHK

SEQ ID NO: 7341 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtgaagagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcggcgaactgaccaatgtaaaagtggttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaacgcagcggcggaagaactgatacagctgtgtcgcaaccgcaacgccttgaag

SEQ ID NO: 7342 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGEEFPFPAIRLSKREQDKMREMFGTEPDEEDPLAPGNAGIMLMCTSRVIEAKYLDYCGELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRARREEEMNAAAEELIQLCRNRNALK

SEQ ID NO: 7343 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaccgggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaacgcagcggcggaagaactgatacagctgtgtcgcaaccgcaacgccttgaag

SEQ ID NO: 7344 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPPGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRARREEEMNAAAEELIQLCRNRNALK

SEQ ID NO: 7345 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcataaaaggcagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7346 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKGRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRARREEEMNAAAEELIQLCRNRNAYK

SEQ ID NO: 7347 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaaacgaccgggtgaagagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7348 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGEEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRARREEEMNAAAEELIQLCRNRNAYK

SEQ ID NO: 7349 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaacgcagcggcggaagaactgatacagctgtgtcgcaaccgcaacgccttgaag

SEQ ID NO: 7350 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRARREEEMNAAAEELIQLCRNRNALK

SEQ ID NO: 7351 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaagaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7352 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPRGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRARREEEMNAAAEELIQLCRNRNAYK

SEQ ID NO: 7353 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcggcgaactgaccaatgtaaaagtggttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaacgcagcggcggaagaactgatacagctgtgtcgcaaccgcaacgcccacaag

SEQ ID NO: 7354 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCGELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRARREEEMNAAAEELIQLCRNRNAHK

SEQ ID NO: 7355 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcataagaaaaagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaaacgaccgggtcatgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcacggaactgaccaatgtaaaagtggttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaccgggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaacgcagcggcggaagaactgatacagctgtgtcgcaaccgcaacgccttgaag

SEQ ID NO: 7356 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIRKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPPGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRARREEEMNAAAEELIQLCRNRNALK

SEQ ID NO: 7357 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaagcgaccgggtgaagagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaacgcagcggcggaagaactgatacagctgtgtcgcaaccgcaacgcccacaag

SEQ ID NO: 7358 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGEEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRARREEEMNAAAEELIQLCRNRNAHK

SEQ ID NO: 7359 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaacaggtcgccctagaacaggggatcccggctgttccggttctaaccagtggtgcggcactgtttagctactttttcaacttcctgaaacgaccgggtcatgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaacgggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattaccggccccactggtgagatcctgcgcgcgaaagtacgcgacattagcaaacgcctgagagcgagacgcgaggaggaaatgaacgcagcggcggaagaactgatacagctgtgtcgcaaccgcaacgcccacaag

SEQ ID NO: 7360 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEQVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPTGFLERVGDRGRVLDHLVPQAHILNHPSTGGFISHCGWNSVMESIDFGVPIIAMPMQWDQPINARLLVELGVAVEIVRDEDGRIHRGEIAQVLKDVITGPTGEILRAKVRDISKRLRARREEEMNAAAEELIQLCRNRNAHK

SEQ ID NO: 7361 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggtgcgggtatgaggatcccgatcattaacaagcacggcgcggatgaattccgtaaagagctggaaagcgcgatgtgggatagcccgagtgacgaggaagttgcgtgcctgattaccgatgcgctgtggtacttcgcgcaaccggtggcggacagcctgaatctgaaacgtctggttctgcagaccagcagcctgtttaacttccacgtcctgctgtgcctgccgaaatttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataaggccgatcgaagcattgctcccggtggcagcagctacgagagcctggaacgcctggttagctatattagcagcctg

SEQ ID NO: 7362 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQTEWLRNLPTHGPGAGMRIPIINKHGADEFRKELESAMWDSPSDEEVACLITDALWYFAQPVADSLNLKRLVLQTSSLFNFHVLLCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKADRSIAPGGSSYESLERLVSYISSL

SEQ ID NO: 7363 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggtgcgggtaagaggatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgcagaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagcgaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7364 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQTEWLRNLPTHGPGAGKRIPIINKHGADEFRKELESAMRDSPSDEEVACLITDALWYFAQPVADSLNLKRLVLQTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7365 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggtgcgggtaagaggatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgcagaccagcagcctgtttaacttccacgccctggtgtgcctgccgaaatttttagagcttggctacctggatccggaagataaacatcgtccggaggaaccggtggtaggtttcccgatgctgaaggttaaagatatccgtcgcgcgtatagccactggcaggaagcgaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggctgtatggaggccgtgtgcgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7366 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQTEWLRNLPTHGPGAGKRIPIINKHGADEFRKELESAMRDSPSDEEVACLITDALWYFAQPVADSLNLKRLVLQTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGCMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7367 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggtgcgggtaagaggatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcacgatggaggccgtgtgcgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataaggccgatcgaagcattgctcccggtggcagcagctacgagagcctggaacgcctggttagctatattagcagcctg

SEQ ID NO: 7368 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQTEWLRNLPTHGPGAGKRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKADRSIAPGGSSYESLERLVSYISSL

SEQ ID NO: 7369 - DNA, 1371 bp, Artificial Sequence; identical to SEQ ID NO: 7363
  "Variant of ADP-beta-1,3-glucosyltransferase"

SEQ ID NO: 7370 - protein, 457 aa, Artificial Sequence; identical to SEQ ID NO: 7364
  "Variant of ADP-beta-1,3-glucosyltransferase"

SEQ ID NO: 7371 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggtgcgggtatgaggatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgcagaccagcagcctgtttaacttccacgcgctggtgtgcctgccgcaatttttagagcttggctacctggatccggaagataaacatcgtccggaggaaccggtggtaggtttcccgatgctgaaggttaaagatatccgtcgcgcgtatagccactggcaggaagcgaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7372 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQTEWLRNLPTHGPGAGMRIPIINKHGADEFRKELESAMRDSPSDEEVACLITDALWYFAQPVADSLNLKRLVLQTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7373 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggtgcgggtaagaggatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgcagaccagcagcctgtttaacttccacgcgctggtgtgcctgccgaaatttttagagcttggctacctggatccggaagataaacatcgtccggaggaaccggtggtaggtttcccgatgctgaaggttaaagatatccgtcgcgcgtatagccactggcaggaagcgaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggctgtatggaggccgtgtgcgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataaggccgatcgaagcattgctcccggtggcagcagctacgagagcctggaacgcctggttagctatattagcagcctg

SEQ ID NO: 7374 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQTEWLRNLPTHGPGAGKRIPIINKHGADEFRKELESAMRDSPSDEEVACLITDALWYFAQPVADSLNLKRLVLQTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGCMEAVCEGVPMIFSDFGLDQPLNARYMSEVLHVGVYLENGFERGEIVNAIRRVMVDPEGEVMRQNARKLKDKADRSIAPGGSSYESLERLVSYISSL

SEQ ID NO: 7375 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggtgcgggtatgacgatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgcagaccagcagcctgtttaacttccacgcgctggtgtgcctgccgaaatttttagagcttggctacctggatccggaagataaacatcgtccggaggaaccggtggtaggtttcccgatgctgaaggttaaagatatccgtcgcgcgtatagccactggcaggaagcgaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcacgatggaggccgtgtgcgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7376 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQTEWLRNLPTHGPGAGMTIPIINKHGADEFRKELESAMRDSPSDEEVACLITDALWYFAQPVADSLNLKRLVLQTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7377 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggtgcgggtatgacgatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgcagaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagcgaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7378 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQTEWLRNLPTHGPGAGMTIPIINKHGADEFRKELESAMRDSPSDEEVACLITDALWYFAQPVADSLNLKRLVLQTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7379 - DNA, 1371 bp, Artificial Sequence
  "Variant of ADP-beta-1,3-glucosyltransferase"
atgccaaacacaagcgagaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgctccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtctaagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaagtgagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 7380 - protein, 457 aa, Artificial Sequence
  "Variant of ADP-beta-1,3-glucosyltransferase"
MPNTSETTVRRRRVILFPVPFPGHLNPMLQLANVLYRRGFAITILHTNFNAPKTSLYPHFSFRFILDNAPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRLSSGVIWNSFKELEESELETVWREIPAPSFLLPLPKHYRASSSSLLDEDPSVAQWLDQQPPSSVLYVGFGSQSEVDEKDFLEIARGLVDSKVSFLWRVRPGFVKGSEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7381 - DNA, 1371 bp, Artificial Sequence
  "Variant of ADP-beta-1,3-glucosyltransferase"
atgccaaacacaaccgagaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgacagcaaagtgagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7382 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQTEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVDSKVSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7383 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgctccgcagaccgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaagtgagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 7384 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNAPQTEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKVSFLWRVRPGFVKGSEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7385 - DNA, 1371 bp, Artificial Sequence
  "Variant of ADP-beta-1,3-glucosyltransferase"
atgccaaacacaagcgagaccaccgtgcgtcgtcgtcgtgttattctgtttccggttccgttcccgggccaccagaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgattattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttctgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7386 - protein, 457 aa, Artificial Sequence
  "Variant of ADP-beta-1,3-glucosyltransferase"
MPNTSETTVRRRRVILFPVPFPGHQNPMLQLANVLYRRGFAITILHTNFNAPKTSLYPHFSFRFILDNDPQTEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKQSFLWRVRPGFVKGSEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7387 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 7388 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7389 - DNA, 1371 bp, Artificial Sequence
  "Variant of ADP-beta-1,3-glucosyltransferase"
atgccaaacacaagcgagaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatcctagcgtggcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgagattatgcgtcaaaacgcgcgtaaattgaaggataagttggatcgaagcattgctcccggtggcagcagctacgagagcctggaacgcctggttagctatattagcagcctg

SEQ ID NO: 7390 - protein, 457 aa, Artificial Sequence
  "Variant of ADP-beta-1,3-glucosyltransferase"
MPNTSETTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEIMRQNARKLKDKLDRSIAPGGSSYESLERLVSYISSL

SEQ ID NO: 7391 - DNA, 1371 bp, Artificial Sequence
  "Variant of ADP-beta-1,3-glucosyltransferase"
atgccaaacacaaccgagaccaccgtgcgtcgtcgtcgtgttattctgtttccggttccgttcccgggccaccagaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggaccccaaagatttcctggagattgcgcgtggtctggttgacagcaaagtgagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7392 - protein, 457 aa, Artificial Sequence
  "Variant of ADP-beta-1,3-glucosyltransferase"
MPNTTETTVRRRRVILFPVPFPGHQNPMLQLANVLYRRGFAITILHTNFNAPKTSLYPHFSFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVDSKVSFLWRVRPGFVKGSEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7393 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7394 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQTEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKQSFLWRVRPGFVKGSEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7395 - DNA, 1371 bp, Artificial Sequence
  "Variant of ADP-beta-1,3-glucosyltransferase"
atgccaaacacaagcgagaccaccgtgcgtcgtcgtcgtgttattctgtttccggttccgttcccgggccaccagaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggacgagaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 7396 - protein, 457 aa, Artificial Sequence
  "Variant of ADP-beta-1,3-glucosyltransferase"
MPNTSETTVRRRRVILFPVPFPGHQNPMLQLANVLYRRGFAITILHTNFNAPKTSLYPHFSFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDEKDFLEIARGLVDSKQSFLWRVRPGFVKGSEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7397 - DNA, 1371 bp, Artificial Sequence
  "Variant of ADP-beta-1,3-glucosyltransferase"
atgccaaacacaagcgagaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgagaaagatttcctggagattgcgcgtggtctggttgacagcaaagtgagctttctgtggcgggttcgtccgggcttcgtgaagggttctgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7398 - protein, 457 aa, Artificial Sequence
  "Variant of ADP-beta-1,3-glucosyltransferase"
MPNTSETTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKVSFLWRVRPGFVKGSEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7399 - DNA, 1371 bp, Artificial Sequence
  "Variant of ADP-beta-1,3-glucosyltransferase"
atgccaaacacaagcgagaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgattattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 7400 - protein, 457 aa, Artificial Sequence
  "Variant of ADP-beta-1,3-glucosyltransferase"
MPNTSETTVRRRRVILFPVPFPGHLNPMLQLANVLYRRGFAITILHTNFNAPKTSLYPHFSFRFILDNDPQTEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKQSFLWRVRPGFVKGSEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7401 - DNA, 1371 bp, Artificial Sequence
  "Variant of ADP-beta-1,3-glucosyltransferase"
atgccaaacacaacccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtctaagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaagtgagctttctgtggcgggttcgtccgggcttcgtgaagggttctgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 7402 - protein, 457 aa, Artificial Sequence
  "Variant of ADP-beta-1,3-glucosyltransferase"
MPNTTPTTVRRRRVILFPVPFPGHLNPMLQLANVLYRRGFAITILHTNFNAPKTSLYPHFSFRFILDNDPQTEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRLSSGVIWNSFKELEESELETVWREIPAPSFLLPLPKHYRASSSSLLDEDPSVAQWLDQQPPSSVLYVGFGSQSEVDPKDFLEIARGLVDSKVSFLWRVRPGFVKGSEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7403 - DNA, 1371 bp, Artificial Sequence
  "Variant of ADP-beta-1,3-glucosyltransferase"
atgccaaacacaaccgagaccaccgtgcgtcgtcgtcgtgttattctgtttccggttccgttcccgggccaccagaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgactattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgagaaagatttcctggagattgcgcgtggtctggttgacagcaaagtgagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcaagccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7404 - protein, 457 aa, Artificial Sequence
  "Variant of ADP-beta-1,3-glucosyltransferase"
MPNTTETTVRRRRVILFPVPFPGHQNPMLQLANVLYRRGFAITILHTNFNAPKTSLYPHFSFRFILDNDPQTEWLRNLPTHGPGAGMRIPTINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKVSFLWRVRPGFVKGYEWIELLPDGFLGEKGRIVKSCPQQEVLAHKAIGAFWTHGGWNGTMEAVCEGKPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7405 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccagaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgattattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggacgagaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7406 - protein, 457 aa, Artificial Sequence
  "Variant of ADP-beta-1,3-glucosyltransferase"
MPNTTETTVRRRRVILFPVPFPGHQNPMLQLANVLYRRGFAITILHTNFNAPKTSLYPHFSFRFILDNDPQTEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDEKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7407 - DNA, 1371 bp, Artificial Sequence
  "Variant of ADP-beta-1,3-glucosyltransferase"
atgccaaacacaacccccaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtctaagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaagtgagctttctgtggcgggttcgtccgggcttcgtgaagggttctgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcaagccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgagattatgcgtcaaaacgcgcgtaaattgaaggataagttggatcgaagcattgctcccggtggcagcagctacgagagcctggaacgcctggttagctatattagcagcctg

SEQ ID NO: 7408 - protein, 457 aa, Artificial Sequence
  "Variant of ADP-beta-1,3-glucosyltransferase"
MPNTTPTTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRLSSGVIWNSFKELEESELETVWREIPAPSFLLPLPKHYRASSSSLLDEDPSVAQWLDQQPPSSVLYVGFGSQSEVDPKDFLEIARGLVDSKVSFLWRVRPGFVKGSEWIELLPDGFLGEKGRIVKSCPQQEVLAHKAIGAFWTHGGWNGTMEAVCEGKPMIFSDFGLDQPLNARYMSEVLHVGVYLENGFERGEIVNAIRRVMVDPEGEIMRQNARKLKDKLDRSIAPGGSSYESLERLVSYISSL

SEQ ID NO: 7409 - DNA, 1371 bp, Artificial Sequence
  "Variant of ADP-beta-1,3-glucosyltransferase"
atgccaaacacaaccgagaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcaagccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgagattatgcgtcaaaacgcgcgtaaattgaaggataagttggatcgaagcattgctcccggtggcagcagctacgagagcctggaacgcctggttagctatattagcagcctg

SEQ ID NO: 7410 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGKPMIFSDFGLDQPLNARYMSEVLHVGVYLENGFERGEIVNAIRRVMVDPEGEIMRQNARKLKDKLDRSIAPGGSSYESLERLVSYISSL

SEQ ID NO: 7411 - DNA, 1371 bp, Artificial Sequence
  "Variant of ADP-beta-1,3-glucosyltransferase"
atgccaaacacaaccgagaccaccgtgcgtcgtcgtcgtgttattctgtttccggttccgttcccgggccaccagaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtctaagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttctgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7412 - protein, 457 aa, Artificial Sequence
  "Variant of ADP-beta-1,3-glucosyltransferase"
MPNTTETTVRRRRVILFPVPFPGHQNPMLQLANVLYRRGFAITILHTNFNAPKTSLYPHFSFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRLSSGVIWNSFKELEESELETVWREIPAPSFLLPLPKHYRASSSSLLDEDPSVAQWLDQQPPSSVLYVGFGSQSEVDPKDFLEIARGLVDSKQSFLWRVRPGFVKGSEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7413 - DNA, 1371 bp, Artificial Sequence
  "Variant of ADP-beta-1,3-glucosyltransferase"
atgccaaacacaaccgagaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtctaagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7414 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQTEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRLSSGVIWNSFKELEESELETVWREIPAPSFLLPLPKHYRASSSSLLDEDPSVAQWLDQQPPSSVLYVGFGSQSEVDPKDFLEIARGLVDSKQSFLWRVRPGFVKGSEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7415 - DNA, 1371 bp, Artificial Sequence
  "Variant of ADP-beta-1,3-glucosyltransferase"
atgccaaacacaaccgagaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgaaaaagatttcctggagattgcgcgtggtctggttgacagcaaagtgagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7416 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKVSFLWRVRPGFVKGSEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7417 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaagtgagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcaagccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7418 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKVSFLWRVRPGFVKGYEWIELLPDGFLGEKGRIVKSCPQQEVLAHKAIGAFWTHGGWNGTMEAVCEGKPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7419 - DNA, 1371 bp, Artificial Sequence
  "Variant of ADP-beta-1,3-glucosyltransferase"
atgccaaacacaaccgaaaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgagaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7420 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7421 - DNA, 1371 bp, Artificial Sequence
  "Variant of ADP-beta-1,3-glucosyltransferase"
atgccaaacacaagcgagaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaagtgagctttctgtggcgggttcgtccgggcttcgtgaagggttctgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7422 - protein, 457 aa, Artificial Sequence
  "Variant of ADP-beta-1,3-glucosyltransferase"
MPNTSETTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKVSFLWRVRPGFVKGSEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7423 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacataaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgagaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7424 - protein, 457 aa, Artificial Sequence
  "Variant of ADP-beta-1,3-glucosyltransferase"
MPNTSPTTVRRRRVILFPVPFPGHINPMLQLANVLYRRGFAITILHTNFNAPKTSLYPHFSFRFILDNDPQTEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7425 - DNA, 1371 bp, Artificial Sequence
  "Variant of ADP-beta-1,3-glucosyltransferase"
atgccaaacacaaccgagaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcaccgcccaatggctggaccagcaaccgccgagcagcgtgctgtacgttggctttggcagccagagcgaggtggacgaaaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcaagccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 7426 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDEKDFLEIARGLVDSKQSFLWRVRPGFVKGYEWIELLPDGFLGEKGRIVKSCPQQEVLAHKAIGAFWTHGGWNGTMEAVCEGKPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7427 - DNA, 1371 bp, Artificial Sequence
  "Variant of ADP-beta-1,3-glucosyltransferase"
atgccaaacacaaccgagaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgcgagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgagaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcaagccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 7428 - protein, 457 aa, Artificial Sequence
  "Variant of ADP-beta-1,3-glucosyltransferase"
MPNTTETTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGYEWIELLPDGFLGEKGRIVKSCPQQEVLAHKAIGAFWTHGGWNGTMEAVCEGKPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7429 - DNA, 1371 bp, Artificial Sequence
  "Variant of ADP-beta-1,3-glucosyltransferase"
atgccaaacacaagcgagaccaccgtgcgtcgtcgtcgtgttattctgtttccggttccgttcccgggccaccttaacccgatgctgcaactggcgaacgtgctgtaccgtagaggttttgcgatcaccattctgcacaccaacttcaacgccccgaaaaccagcctttatccgcacttcagctttcgttttatcttggacaacgctccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtctaagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgttccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7430 - protein, 457 aa, Artificial Sequence
  "Variant of ADP-beta-1,3-glucosyltransferase"
MPNTSETTVRRRRVILFPVPFPGHLNPMLQLANVLYRRGFAITILHTNFNAPKTSLYPHFSFRFILDNAPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRLSSGVIWNSFKELEESELETVWREIPAPSFLLPLPKHYRASSSSLLDEDPSVAQWLDQQPPSSVLYVGFGSQSEVDPKDFLEIARGLVDSKQSFLWRVRPGFVKGSEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7431 - DNA, 1371 bp, Artificial Sequence
  "Variant of ADP-beta-1,3-glucosyltransferase"
atgccaaacacaagcgagaccaccgtgcgtcgtcgtcgtgttattctgtttccggttccgttcccgggccaccagaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtctaagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgagaaagatttcctggagattgcgcgtggtctggttgacagcaaagtgagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 7432 - protein, 457 aa, Artificial Sequence
  "Variant of ADP-beta-1,3-glucosyltransferase"
MPNTSETTVRRRRVILFPVPFPGHQNPMLQLANVLYRRGFAITILHTNFNAPKTSLYPHFSFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRLSSGVIWNSFKELEESELETVWREIPAPSFLLPLPKHYRASSSSLLDEDPSVAQWLDQQPPSSVLYVGFGSQSEVDEKDFLEIARGLVDSKVSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7433 - DNA, 1371 bp, Artificial Sequence
  "Variant of ADP-beta-1,3-glucosyltransferase"
atgccaaacacaacccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgatcattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggtagcgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggtgatgcgtcaaaacgcgcgtaaattgaaggataagttggatcgaagcattgctcccggtggcagcagctacgagagcctggaacgcctggttagctatattagcagcctg

SEQ ID NO: 7434 - protein, 457 aa, Artificial Sequence
  "Variant of ADP-beta-1,3-glucosyltransferase"
MPNTTPTTVRRRRVILFPVPFPGHLNPMLQLANVLYRRGFAITILHTNFNAPKTSLYPHFSFRFILDNDPQTEWLRNLPTHGPGAGMRIPIINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKQSFLWRVRPGFVKGSEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7435 - DNA, 1371 bp, Artificial Sequence
  "Variant of ADP-beta-1,3-glucosyltransferase"
atgccaaacacaaccgagaccaccgtgcgtcgtcgtcgtgttattctgtttccggttccgttcccgggccaccagaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggacgagaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcaagccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 7436 - protein, 457 aa, Artificial Sequence
  "Variant of ADP-beta-1,3-glucosyltransferase"
MPNTTETTVRRRRVILFPVPFPGHQNPMLQLANVLYRRGFAITILHTNFNAPKTSLYPHFSFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDEKDFLEIARGLVDSKQSFLWRVRPGFVKGYEWIELLPDGFLGEKGRIVKSCPQQEVLAHKAIGAFWTHGGWNGTMEAVCEGKPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7437 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctgggtcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggacacatagactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcatgggtggtccgggagaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7438 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLGRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHIDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRMGGPGEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7439 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccaggatccgtggatggtttttgcgtggcgtctacgtccaggtgtttgggagtatgtgcgcatacatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggacaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtatctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7440 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFQDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSYLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7441 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaagggcttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaagcacacaaagactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7442 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEAHKDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7443 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgctgtcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7444 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRCHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7445 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtatctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctagaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7446 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSYLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7447 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaatggcttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7448 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEWLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7449 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaagcacaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtatctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgggagaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7450 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEAHQDYTLPGLYRVENGIDVFDSKFNIVSPGADARTYFSYARTEERFSYLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPGEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7451 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggacaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctagaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7452 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7453 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggacacatagactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctagaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7454 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHIDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7455 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggacaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctagaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7456 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7457 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagtttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaagcacaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgggagaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7458 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEAHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPGEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7459 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccaggatccgtggatggtttttgcgtggcgtctacgtccaggtgtttgggagtatgtgcgcatacatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctagaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7460 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFQDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7461 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctgggtcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtatctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7462 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLGRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSYLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7463 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacaacctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcacatagactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcatgggtggtccgggagaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7464 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHIDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRMGGPGEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7465 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaatggcttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7466 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEWLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7467 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctgggtcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggacaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtatctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcatgggtggtccgggagaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7468 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLGRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSYLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRMGGPGEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7469 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtatctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7470 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSYLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7471 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccaggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctgggtcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaagcacaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgcaagaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7472 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFQDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLGRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEAHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPQEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7473 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaagcacaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtatctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7474 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEAHQDYTLPGLYRVENGIDVFDSKFNIVSPGADARTYFSYARTEERFSYLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7475 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccaggatccgtggatggtttttgcgtggcgtctacgtccaggtgtttgggagtatgtgcgcatacatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcatgggtggtccggcagaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7476 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFQDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRMGGPAEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7477 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggcttgcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctgggtcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaagcacacagagactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccggcagaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7478 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLGRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEAHRDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPAEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7479 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggacaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtatctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgcaagaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7480 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSYLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPQEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7481 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggacaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7482 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7483 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcacatagactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgcaagaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7484 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHIDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPQEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7485 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaagcacacagagactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7486 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEAHRDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7487 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgcgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgggagaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7488 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPGEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7489 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctgggtcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtatctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7490 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLGRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSYLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7491 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccggcagaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7492 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPAEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7493 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaagcacaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7494 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEAHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7495 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccaggatccgtggatggtttttgcgtggcgtctacgtccaggtgtttgggagtatgtgcgcatacatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggacacagagactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7496 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFQDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHRDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7497 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccaggatccgtggatggtttttgcgtggcgtctacgtccaggtgtttgggagtatgtgcgcatacatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctagaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7498 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFQDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7499 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccaggatccgtggatggtttttgcgtggcgtctacgtccaggtgtttgggagtatgtgcgcatacatgtagaacagctggcggtggaggagctgagcactgatgaatatctgcaagccaaagaagggcttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaagcacaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7500 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFQDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEAHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7501 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctgggtcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaagcacacatagactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctagaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7502 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLGRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEAHIDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7503 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctgggtcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7504 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLGRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7505 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7506 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7507 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccaggatccgtggatggtttttgcgtggcgtctacgtccaggtgtttgggagtatgtgcgcatacatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcatgggtggtccgcaagaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7508 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFQDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRMGGPQEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7509 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaagcacacagagactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7510 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEAHRDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7511 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccaggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7512 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFQDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7513 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcacatagactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcatgggtggtccgctagaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7514 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHIDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRMGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7515 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaagggcttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7516 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7517 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccagctgtttgggagtatgtgcgcatacatgtagaacagctggcggtggaggagctgagcactgatgaatatctgcaagccaaagaagggcttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctgggtcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaagcacacatagactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7518 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPAVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLGRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEAHIDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7519 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcacaaagactatactttaccgggcttgtatcgtgtcgagaatggtattgacgtgttcgatagcaagtttaacattgtgagtccgggcgcagatgcgcgcacgtattttagctatgcccgtactgaagaacgcttctcgtatctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7520 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHKDYTLPGLYRVENGIDVFDSKFNIVSPGADARTYFSYARTEERFSYLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7521 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccaggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtatctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7522 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFQDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSYLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7523 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggacacagagactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcatgggtggtccgctagaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7524 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHRDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRMGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7525 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcatgggtggtccgggagaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7526 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRMGGPGEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7527 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctgggtcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcatgggtggtccgcaagaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7528 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLGRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRMGGPQEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7529 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccaggatccgtggatggtttttgcgtggcgtctacgtccaggtgtttgggagtatgtgcgcatacatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctgggtcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaagcacaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtatctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7530 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFQDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLGRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEAHQDYTLPGLYRVENGIDVFDSKFNIVSPGADARTYFSYARTEERFSYLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7531 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtatctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7532 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSYLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7533 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcatgggtggtccggcagaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7534 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRMGGPAEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7535 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaagcacaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7536 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEAHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7537 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcacagagactatactttaccgggcttgtatcgtgtcgagaatggtattgacgtgttcgatagcaagtttaacattgtgagtccgggcgcagatgcgcgcacgtattttagctatgcccgtactgaagaacgcttctcgtatctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctagaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7538 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHRDYTLPGLYRVENGIDVFDSKFNIVSPGADARTYFSYARTEERFSYLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7539 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctgggtcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcacaaagactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctagaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7540 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLGRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHKDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7541 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccaggatccgtggatggtttttgcgtggcgtctacgtccaggtgtttgggagtatgtgcgcattcatgtagaacagctggcggtggaggagctgagcactgatgaatatctgcaagccaaagaatggcttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccggcagaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7542 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFQDPWMVFAWRLRPGVWEYVRIHVEQLAVEELSTDEYLQAKEWLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPAEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7543 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccaggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctgggtcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaagcacacagagactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcatgggtggtccgctagaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7544 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFQDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLGRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEAHRDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRMGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7545 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccaggatccgtggatggtttttgcgtggcgtctacgtccaggtgtttgggagtatgtgcgcatacatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtatctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7546 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFQDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSYLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7547 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaatggcttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctgggtcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7548 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEWLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLGRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7549 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaagcacaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtatctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7550 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEAHQDYTLPGLYRVENGIDVFDSKFNIVSPGADARTYFSYARTEERFSYLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7551 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgctgtcatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcacaaagactatactttaccgggcttgtatcgtgtcgagaatggtattgacgtgttcgatagcaagtttaacattgtgagtccgggcgcagatgcgcgcacgtattttagctatgcccgtactgaagaacgcttctcgtatctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctagaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7552 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRCHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHKDYTLPGLYRVENGIDVFDSKFNIVSPGADARTYFSYARTEERFSYLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7553 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaagggcttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggacacatagactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcatgggtggtccgctagaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7554 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHIDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRMGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7555 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccaggatccgtggatggtttttgcgtggcgtctacgtccaggtgtttgggagtatgtgcgcatacatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaagcacaccaagactatactttaccgggcttgtatcgtgtcgagaatggtattgacgtgttcgatagcaagtttaacattgtgagtccgggcgcagatgcgcgcacgtattttagctatgcccgtactgaagaacgcttctcgtatctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7556 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFQDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEAHQDYTLPGLYRVENGIDVFDSKFNIVSPGADARTYFSYARTEERFSYLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7557 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctgggtcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggacacagagactatactttaccgggcttgtatcgtgtcgagaatggtattgacgtgttcgatagcaagtttaacattgtgagtccgggcgcagatgcgcgcacgtattttagctatgcccgtactgaagaacgcttctcgtatctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctagaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7558 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLGRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHRDYTLPGLYRVENGIDVFDSKFNIVSPGADARTYFSYARTEERFSYLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7559 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctgggtcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcacagagactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7560 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLGRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHRDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7561 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctgggtcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtatctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7562 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLGRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADARTYFSYARTEERFSYLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7563 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctagaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7564 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7565 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcatgggtggtccgggagaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7566 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRMGGPGEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7567 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctgggtcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaagcacacagagactatactttaccgggcttgtatcgtgtcgagaatggtattgacgtgttcgatagcaagtttaacattgtgagtccgggcgcagatgcgcgcacgtattttagctatgcccgtactgaagaacgcttctcgtatctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctagaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7568 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLGRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEAHRDYTLPGLYRVENGIDVFDSKFNIVSPGADARTYFSYARTEERFSYLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7569 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaagggcttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcatgggtggtccggcagaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7570 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRMGGPAEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7571 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgctgtcatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtatctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7572 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRCHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADARTYFSYARTEERFSYLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7573 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccaggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggacacagagactatactttaccgggcttgtatcgtgtcgagaatggtattgacgtgttcgatagcaagtttaacattgtgagtccgggcgcagatgcgcgcacgtattttagctatgcccgtactgaagaacgcttctcgtatctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7574 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFQDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHRDYTLPGLYRVENGIDVFDSKFNIVSPGADARTYFSYARTEERFSYLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7575 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctagaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7576 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7577 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgctgtcatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7578 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRCHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7579 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaagcacaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcatgggtggtccgctagaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7580 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEAHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRMGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7581 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggatttttgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaatggcttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccggcagaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7582 - protein, 793 aa, Artificial Sequence
  "Variant of ADP-beta-1,3-glucosyltransferase"
MIEELRQQLLDDPRSWRAFLRHLVASQRDSWLHTDLQRACADFCEQPPEGYPEDIGWLADFVAHTQEAIFRDPWMVFAWRLRPGVWEYVRIHVEQLAVEELSTDEYLQAKEWLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPAEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7583 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaagtcggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggacacatagactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcatgggtggtccggcagaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7584 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEVGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHIDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRMGGPAEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7585 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggcttgcagattttgtggcacatacccaggaagcgatcttccaggatccgtggatggtttttgcgtggcgtctacgtccaggtgtttgggagtatgtgcgcattcatgtagaacagctggcggtggaggagctgagcactgatgaatatctgcaagccaaagaatggcttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctgggtcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcacagagactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgcaagaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7586 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFQDPWMVFAWRLRPGVWEYVRIHVEQLAVEELSTDEYLQAKEWLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLGRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHRDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPQEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7587 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcatgggtggtccgcaagaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7588 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRMGGPQEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7589 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagcgcgcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7590 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSARLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7591 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatcttgcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7592 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEILRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7593 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtcaatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7594 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVNGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7595 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgctgtcagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7596 - protein, 793 aa, Artificial Sequence
  "Variant of ADP-beta-1,3-glucosyltransferase"
MIEELRQQLLDDPRSWRAFLRHLVASQRDSWLHTDLQRACADFRCQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7597 - DNA, 2379 bp, Artificial Sequence
  "Variant of ADP-beta-1,3-glucosyltransferase"
atgattgaagaactgcgccaacagctgctggattgtccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7598 - protein, 793 aa, Artificial Sequence
  "Variant of ADP-beta-1,3-glucosyltransferase"
MIEELRQQLLDCPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7599 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggagccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7600 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFREPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7601 - DNA, 2379 bp, Artificial Sequence
  "Variant of ADP-beta-1,3-glucosyltransferase"
atgattgaagaactgcgccaacagctgctggatgttccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7602 - protein, 793 aa, Artificial Sequence
  "Variant of ADP-beta-1,3-glucosyltransferase"
MIEELRQQLLDVPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7603 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgacattgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7604 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDIEIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7605 - DNA, 2379 bp, Artificial Sequence
  "Variant of ADP-beta-1,3-glucosyltransferase"
atgattgaagaactgcgccaacagctgctggatagtccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7606 - protein, 793 aa, Artificial Sequence
  "Variant of ADP-beta-1,3-glucosyltransferase"
MIEELRQQLLDSPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7607 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctgttgaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7608 - protein, 793 aa, Artificial Sequence
  "Variant of ADP-beta-1,3-glucosyltransferase"
MIEELRQQLLDDPRSWRAFLRHLVASQRDSWLHTDLQRACADFREQPVEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7609 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcatgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7610 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGMHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7611 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtcgcgggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7612 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVAGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7613 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgggcagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7614 - protein, 793 aa, Artificial Sequence
  "Variant of ADP-beta-1,3-glucosyltransferase"
MIEELRQQLLDDPRSWRAFLRHLVASQRDSWLHTDLQRACADFRGQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7615 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccagcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7616 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSQRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7617 - DNA, 2379 bp, Artificial Sequence
  "Variant of ADP-beta-1,3-glucosyltransferase"
atgattgaagaactgcgccaacagctgctggatcagccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgcccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7618 - protein, 793 aa, Artificial Sequence
  "Variant of ADP-beta-1,3-glucosyltransferase"
MIEELRQQLLDQPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7619 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggctcgttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7620 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGSLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7621 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaagttctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7622 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEVLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7623 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctaaggccgtaccgatggag

SEQ ID NO: 7624 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAKAVPME

SEQ ID NO: 7625 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatccggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7626 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYPDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7627 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtggttcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7628 - protein, 793 aa, Artificial Sequence
  "Variant of ADP-beta-1,3-glucosyltransferase"
MIEELRQQLLDDPRSWRAFLRHLVASQRGSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7629 - DNA, 2379 bp, Artificial Sequence
  "Variant of ADP-beta-1,3-glucosyltransferase"
atgattgaagaactgcgcaaacagctgctggatcttccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7630 - protein, 793 aa, Artificial Sequence
  "Variant of ADP-beta-1,3-glucosyltransferase"
MIEELRKQLLDLPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7631 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggagaagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7632 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEKLSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7633 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7634 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQMRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7635 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgtcgtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7636 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPSYWEEISDAALARVSERYTWERYAERLMTIARVFGFWRFVLSRESQVMERYLQMFRHLQWRPLAHAVPME

SEQ ID NO: 7637 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagattccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagtggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7638 - protein, 793 aa, Artificial Sequence
  "Variant of ADP-beta-1,3-glucosyltransferase"
MIEELRQQLLDDPRSWRAFLRHLVASQRDSWLHTDLQRACADFREQIPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7639 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaaaatctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7640 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVENLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7641 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatgatggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7642 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDDGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7643 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacaggtgccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7644 - protein, 793 aa, Artificial Sequence
  "Variant of ADP-beta-1,3-glucosyltransferase"
MIEELRQQLLDDPRSWRAFLRHLVASQRDSWLHTDLQRACADFREQVPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7645 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatcaagcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7646 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIKRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7647 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccctcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7648 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSPRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7649 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccatgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7650 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDHEIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7651 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgttcagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7652 - protein, 793 aa, Artificial Sequence
  "Variant of ADP-beta-1,3-glucosyltransferase"
MIEELRQQLLDDPRSWRAFLRHLVASQRDSWLHTDLQRACADFRVQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7653 - DNA, 2379 bp, Artificial Sequence
  "Variant of ADP-beta-1,3-glucosyltransferase"
atgattgaagaactgcgccaacagctgctggataatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7654 - protein, 793 aa, Artificial Sequence
  "Variant of ADP-beta-1,3-glucosyltransferase"
MIEELRQQLLDNPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7655 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttgtggaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7656 - protein, 793 aa, Artificial Sequence
  "Variant of ADP-beta-1,3-glucosyltransferase"
MIEELRQQLLDDPRSWRAFLRHLVASQRDSWLHTDLQRACADFVEQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7657 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggccggcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7658 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGRHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7659 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtgcgattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7660 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGAIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7661 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttctggaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7662 - protein, 793 aa, Artificial Sequence
  "Variant of ADP-beta-1,3-glucosyltransferase"
MIEELRQQLLDDPRSWRAFLRHLVASQRDSWLHTDLQRACADFLEQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7663 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtctgattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7664 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGLIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7665 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtccgtcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7666 - protein, 793 aa, Artificial Sequence
  "Variant of ADP-beta-1,3-glucosyltransferase"
MIEELRQQLLDDPRSWRAFLRHLVASQRPSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7667 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagcaagcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7668 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSKRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7669 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggagggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7670 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWRDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7671 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcgtgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7672 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGVHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7673 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagtgtccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7674 - protein, 793 aa, Artificial Sequence
  "Variant of ADP-beta-1,3-glucosyltransferase"
MIEELRQQLLDDPRSWRAFLRHLVASQRDSWLHTDLQRACADFREQCPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7675 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgctcagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7676 - protein, 793 aa, Artificial Sequence
  "Variant of ADP-beta-1,3-glucosyltransferase"
MIEELRQQLLDDPRSWRAFLRHLVASQRDSWLHTDLQRACADFRAQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7677 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcgctggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7678 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGAGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7679 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaagtggaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7680 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEVEMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7681 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctaggcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7682 - protein, 793 aa, Artificial Sequence
  "Variant of ADP-beta-1,3-glucosyltransferase"
MIEELRQQLLDDPRSWRAFLRHLVASRRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7683 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaagcggaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagtgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7684 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEAEEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7685 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaaactctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7686 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVETLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7687 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcctgcagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7688 - protein, 793 aa, Artificial Sequence
  "Variant of ADP-beta-1,3-glucosyltransferase"
MIEELRQQLLDDPRSWRAFLRHLVASQRDSWLHTDLQRACADFRLQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7689 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatctgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7690 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEICRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7691 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgcgtcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagtactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7692 - protein, 793 aa, Artificial Sequence
  "Variant of ADP-beta-1,3-glucosyltransferase"
MIEELRQQLLDDPRSWRAFLRHLVASQRASWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7693 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagaatccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7694 - protein, 793 aa, Artificial Sequence
  "Variant of ADP-beta-1,3-glucosyltransferase"
MIEELRQQLLDDPRSWRAFLRHLVASQRDSWLHTDLQRACADFREQNPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7695 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcatctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7696 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHHLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7697 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgggttattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7698 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPGYWEEISDAALARVSERYTWERYAERLMTIARVFGFWRFVLSRESQVMERYLQMFRHLQWRPLAHAVPME

SEQ ID NO: 7699 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagctttcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7700 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSFRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7701 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagactccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7702 - protein, 793 aa, Artificial Sequence
  "Variant of ADP-beta-1,3-glucosyltransferase"
MIEELRQQLLDDPRSWRAFLRHLVASQRDSWLHTDLQRACADFREQTPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7703 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagttgccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7704 - protein, 793 aa, Artificial Sequence
  "Variant of ADP-beta-1,3-glucosyltransferase"
MIEELRQQLLDDPRSWRAFLRHLVASQRDSWLHTDLQRACADFREQLPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7705 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccgggtgtttgggagtatgtgcgcattcatgtagaactgctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7706 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVELLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7707 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaagatctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7708 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEDLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7709 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtttgtcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7710 - protein, 793 aa, Artificial Sequence
  "Variant of ADP-beta-1,3-glucosyltransferase"
MIEELRQQLLDDPRSWRAFLRHLVASQRLSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7711 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtactattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7712 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGTIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7713 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcactcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7714 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGTHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7715 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggagccgctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7716 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEPLSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7717 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggagcagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7718 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEQLSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7719 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagctgtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7720 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSCGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7721 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaggttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaagtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7722 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGRLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7723 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgttgtttcggcttttggcgcttcgttctgtcacgcgaatcacaggtcatggaacgctatctgcaaatgttccgccacctgcaatggcgcccgctggctcatgccgtaccgatggag

SEQ ID NO: 7724 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARCFGFWRFVLSRESQVMERYLQMFRHLQWRPLAHAVPME

SEQ ID NO: 7725 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7726 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 7727 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacaggatccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7728 - protein, 793 aa, Artificial Sequence
  "Variant of ADP-beta-1,3-glucosyltransferase"
MIEELRQQLLDDPRSWRAFLRHLVASQRDSWLHTDLQRACADFREQDPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7729 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaaagcgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7730 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLKRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7731 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtgctaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7732 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRATVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7733 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggccctcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggccgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7734 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGPPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7735 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctgcggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7736 - protein, 793 aa, Artificial Sequence
  "Variant of ADP-beta-1,3-glucosyltransferase"
MIEELRQQLLDDPRSWRAFLRHLVASQRDSWLHTDLQRACADFREQPAEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7737 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtaggaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7738 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRRTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7739 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagattctggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7740 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDSGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7741 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagcaatcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7742 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSNRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7743 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggcagtcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7744 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGSPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7745 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtatcgtatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7746 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVSYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7747 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttaaaggacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7748 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7749 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctattcggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7750 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYSDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7751 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtgattccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7752 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVIPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7753 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccaaaggaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtctgaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7754 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPKETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7755 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatcatgcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7756 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIMRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7757 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacggggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7758 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDGVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7759 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcagtcagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggaa

SEQ ID NO: 7760 - protein, 793 aa, Artificial Sequence
  "Variant of ADP-beta-1,3-glucosyltransferase"
MIEELRQQLLDDPRSWRAFLRHLVASQRDSWLHTDLQRACADFRSQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7761 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggctttggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7762 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGFGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7763 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcgcggattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcattcatgtagaacagctggcggtggaggagctgagcactgatgaatatctgcaagccaaagaaggacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaaccaggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccaggagattggtcaatatgaaggtcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgcttcggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 7764 - protein, 793 aa, Artificial Sequence
  "Variant of ADP-beta-1,3-glucosyltransferase"
MIEELRQQLLDDPRSWRAFLRHLVASQRDSWLHTDLQRACADFREQPPEGYPEDIGWLADFVAHTQEAIFRDPWMVFAWRLRPGVWEYVRIHVEQLAVEELSTDEYLQAKEGLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDQEIGQYEGHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRFGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 7765 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagatcctttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatcccagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattggcggcgcgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7766 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNIKPDLVLYDFLQPWAEKVALEQGIPAVPVLTSGAALFSYFFNFLKRPGHEFPFPAIRLSKREQDKMREMFGTEPTEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVIGGATGEILRAKVRDISKRLRARREEEMNAAAEELIQLCRNRNAYK

SEQ ID NO: 7767 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggacgaagaagatcctttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatcccagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7768 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNIKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 7769 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagagactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7770 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGERLRAKVRDISKRLRARREEEMNAAAEELIQLCRNRNAYK

SEQ ID NO: 7771 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccataggagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgagagtacgcgacattagcaaacgcctgagagcgagacgcgaggaggaaatgaacgcagcggcggaagaactgatacagctgtgtcgcaaccgcaacgcctacaag

SEQ ID NO: 7772 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHRSTGGFISHCGWNSVMESIDFGVPIIAMPMQWDQPINARLLVELGVAVEIVRDEDGRIHRGEIAQVLKDVISGPTGEILRARVRDISKRLRARREEEMNAAAEELIQLCRNRNAYK

SEQ ID NO: 7773 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatattgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7774 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 7775 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaactggattttttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatattgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7776 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTELDFLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 7777 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggaaatccgcctgtcgaagcgagaacaggataagatgcgcgagatgtttggaacagagccggacgaagaagattttttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccataggagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgagagtacgcgacattagcaaacgcctgagagcgagacgcgaggaggaaatgaacgcagcggcggaagaactgatacagctgtgtcgcaaccgcaacgcctacaag

SEQ ID NO: 7778 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPEIRLSKREQDKMREMFGTEPDEEDFLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHRSTGGFISHCGWNSVMESIDFGVPIIAMPMQWDQPINARLLVELGVAVEIVRDEDGRIHRGEIAQVLKDVISGPTGEILRARVRDISKRLRARREEEMNAAAEELIQLCRNRNAYK

SEQ ID NO: 7779 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggacgaactggattttttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7780 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDELDFLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 7781 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggaaatccgcctgtcgaagcgagaacaggataagatgcgcgagatgtttggaacagagccggacgaagaagatcctttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccataagagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgagagtacgcgacattagcaaacgcctgagagcgagacgcgaggaggaaatgaacgcagcggcggaagaactgatacagctgtgtcgcaaccgcaacgcctacaag

SEQ ID NO: 7782 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPEIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHKSTGGFISHCGWNSVMESIDFGVPIIAMPMQWDQPINARLLVELGVAVEIVRDEDGRIHRGEIAQVLKDVISGPTGEILRARVRDISKRLRARREEEMNAAAEELIQLCRNRNAYK

SEQ ID NO: 7783 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7784 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPLTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 7785 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggacgaagaagattttttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7786 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDFLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 7787 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggaaatccgcctgtcgaagcgagaacaggataagatgcgcgagatgtttggaacagagccggacgaactggattttttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatattgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccataagagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7788 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPEIRLSKREQDKMREMFGTEPDELDFLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHKSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 7789 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggaaatccgcctgtcgaagcgagaacaggataagatgcgcgagatgtttggaacagagccggacgaagaagattttttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7790 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPEIRLSKREQDKMREMFGTEPDEEDFLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 7791 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggaaatccgcctgtcgaagcgagaacaggataagatgcgcgagatgtttggaacagagccgacggaactggattttttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7792 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPEIRLSKREQDKMREMFGTEPTELDFLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 7793 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagatcctttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7794 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 7795 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaagcgcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagttcccgtttccggcaatccgcctgtcgaagcgagaacaggataagatgcgcgagatgtttggaacagagccgacggaagaagattttttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatattgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7796 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQALKPDLVLYDFLQPWAEKVALEQGIPAVPVLTSGAALFSYFFNFLKRPGHEFPFPAIRLSKREQDKMREMFGTEPTEEDFLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 7797 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggaaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgcttaccgaagatattgacgacaaagaactgattgattggttagataccaaacccgaaaacagtgttgtctatgtgtcgtttggcagcgaatacttcctgagccgtgaagatatggaagaagtggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatcccagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7798 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPEIRLSKREQDKMREMFGTEPDEEDPLAPGNAGIMLMCTSRVIEAKYLDYCTELTNVKVVPVGPPFQDPLTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 7799 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggaaatccgcctgtcgaagcgagaacaggataagatgcgcgagatgtttggaacagagccggacgaactggatcctttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7800 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPEIRLSKREQDKMREMFGTEPDELDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 7801 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaacgattaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggacgaagaagatcctttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaactggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7802 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQTIKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEELAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 7803 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccgacggaagaagatcctttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatattgacgaccccgaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatcccagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagagactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7804 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPTEEDPLAPGNAGIMLMCTSRVIEAKYLDYCTELTNVKVVPVGPPFQDPMTEDIDDPELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGERLRAKVRDISKRLRARREEEMNAAAEELIQLCRNRNAYK

SEQ ID NO: 7805 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggaaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccataagagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7806 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPEIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHKSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 7807 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggaaatccgcctgtcgaagcgagaacaggataagatgcgcgagatgtttggaacagagccgacggaagaagatcctttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7808 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNIKPDLVLYDFLQPWAEKVALEQGIPAVPVLTSGAALFSYFFNFLKRPGHEFPFPEIRLSKREQDKMREMFGTEPTEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 7809 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgagagtacgcgacattagcaaacgcctgagagcgagacgcgaggaggaaatgaacgcagcggcggaagaactgatacagctgtgtcgcaaccgcaacgcctacaag

SEQ ID NO: 7810 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNIKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRARVRDISKRLRARREEEMNAAAEELIQLCRNRNAYK

SEQ ID NO: 7811 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaagcgcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggaaatccgcctgtcgaagcgagaacaggataagatgcgcgagatgtttggaacagagccgacggaagaagatcctttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgacaaagaactgattgattggttagataccaaacccgaaaacagtgttgtctatgtgtcgtttggcagcgaatacttcctgagccgtgaagatatggaagaagtggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatcccagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagagactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7812 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQALKPDLVLYDFLQPWAEKVALEQGIPAVPVLTSGAALFSYFFNFLKRPGHEFPFPEIRLSKREQDKMREMFGTEPTEEDPLAPGNAGIMLMCTSRVIEAKYLDYCTELTNVKVVPVGPPFQDPLTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGERLRAKVRDISKRLRARREEEMNAAAEELIQLCRNRNAYK

SEQ ID NO: 7813 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaagcgcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggacgaagaagatcctttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatattgacgaccccgaactgattgattggttagataccaaacccgaaaacagtgttgtctatgtgtcgtttggcagcgaatacttcctgagccgtgaagatatggaagaactggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7814 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQALKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDPELIDWLDTKPENSVVYVSFGSEYFLSREDMEELAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 7815 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggacgaactggattttttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatcttgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattggcggcgcgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7816 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDELDFLAPGNAGIMLMCTSRVIEAKYLDYCTELTNVKVVPVGPPFQDPMTEDLDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVIGGATGEILRAKVRDISKRLRARREEEMNAAAEELIQLCRNRNAYK

SEQ ID NO: 7817 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatattaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatcctttagcacctggcaatgccggtatcatgctgatgtgcacgagccgcgtaattgaggctaagtacctggactattgcaccgaactgaccaatgtaaaagttgttccggttggtccgccatttcaggatccgctgaccgaagatattgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7818 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNIKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPLTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 7819 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggaaatccgcctgtcgaagcgagaacaggataagatgcgcgagatgtttggaacagagccggacgaactggattttttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaactggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatactgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7820 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPEIRLSKREQDKMREMFGTEPDELDFLAPGNAGIMLMCTSRVIEAKYLDYCTELTNVKVVPVGPPFQDPMTEDIDDKELIDWLDTKPENSVVYVSFGSEYFLSREDMEELAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 7821 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaatcttaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggaaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatcccagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7822 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPEIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 7823 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaactggcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7824 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEELAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 7825 - DNA, 1350 bp, Artificial Sequence
  "Variant of ADP-beta-1,3-glucosyltransferase"
atgcaccatcatcatgaaggcgtgagcggtcagaccctgagagtactgatgtttccgtggcttgcgctgggtcatgttaacccgtttttgcgtatcgctaaacaactggccgatcgtggtttcgttatctatttagttagtaccgctattaacctcgagagcatcaaaaagagaatcccggagaaatacagtaatagcatccatctggttgagctggcactgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcagccgtgggcagagaaggtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgcgggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccatgaagatatggaagaagtcgcgttcggcctggagctgagcaacgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccacgtgatgaagatggccggattcaccgcggcgaaattgcccaagtcctgaaagatgtgatttcgggcccgactggtgagatcctgcgcgcgaaagtacgcgacattagcaaacggctgagagcgcgccgcgaggaggaaatgaacgcagcggcggaagaactgatacagctgtgtcgcaaccgcaacgcctacaag

SEQ ID NO: 7826 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSHEDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIPRDEDGRIHRGEIAQVLKDVISGPTGEILRAKVRDISKRLRARREEEMNAAAEELIQLCRNRNAYK

SEQ ID NO: 7827 - DNA, 1350 bp, Artificial Sequence
  "Variant of ADP-beta-1,3-glucosyltransferase"
atgcaccatcatcatgaaggcgtgagcgatcagaccctgagagtactgatgtttccgtggcttgcgctgggtcatgttaacccgtttttgcgtatcgctaaacaactggccgatcgtggtttcgttatctatttagttagtaccgctattaacctcgagagcatcaaaaagagaatcccggagaaatacagtaatagcatccatctggttgagctggcactgccagaattaccggaactgccaccacattaccatactaccaacggtttaccaccgcatctgaacgggaccctgcataaggcactgaagatgagcgctcccaactttagcaagatccttcaaaacctgaagccggacctggtcctttacgattttctgattccgtgggcagagagggtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgcgggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccacgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7828 - protein, 450 aa, Artificial Sequence
  "Variant of ADP-beta-1,3-glucosyltransferase"
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLIPWAERVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIPRDEDGRIHRGEIAQVLKDVISGPTGEILRAKVRDISKRLRARREEEMNAAAEELIQLCRNRNAYK

SEQ ID NO: 7829 - DNA, 1350 bp, Artificial Sequence
  "Variant of ADP-beta-1,3-glucosyltransferase"
atgcaccatcatcatgaaggcgtgagcgatcagaccctgagagtactgatgtttccgtggcttgcgctgggtcatgttaacccgtttttgcgtatcgctaaacaactggccgatcgtggtttcgttatctatttagttagtaccgctattaacctcgagagcatcaaaaagagaatcccggagaaatacagtaatagcatccatctggttgagctgcacctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgttcgtgatgaagatggccggattcaccgcggcgaaattgcccaagtcctgaaagatgtgatttcgggcccgactggtgagatcctgcgcgcgaaagtacgcgacattagcaaacgcctgagagcgcgccgcgaggaggaaatgaacgcagcggcggaagaactgatacagctgtgtcgcaaccgcaacgcctacaag

SEQ ID NO: 7830 - protein, 450 aa, Artificial Sequence
  "Variant of ADP-beta-1,3-glucosyltransferase"
MHHHHEGVSDQTLRVLMFPWLALGHVNPFLRIAKQLADRGFVIYLVSTAINLESIKKRIPEKYSNSIHLVELHLPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 7831 - DNA, 1350 bp, Artificial Sequence
  "Variant of ADP-beta-1,3-glucosyltransferase"
atgcaccatcatcatgaaggcgtgagcgatcagaccctgagagtactgatgtttccgtggcttgcgctgggtcatgttaacccgtttttgcgtatcgctaaacaactggccgatcgtggtttcgttatctatttagttagtaccgctattaacctcaatagcatcaaaaagagaatcccggagaaatacagtaatagcatccatctggttgagctggcactgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgttcgtgatgaagatggccggattcaccgcggcgaaattgcccaagtcctgaaagatgtgatttcgggcccgactggtgagatcctgcgcgcgaaagtacgcgacattagcaaactgctgagagcgcgccgcgaggaggaaatgaacgcagcggcggaagaactgatacagctgtgtcgcaaccgcaacgcctacaag

SEQ ID NO: 7832 - protein, 450 aa, Artificial Sequence
  "Variant of ADP-beta-1,3-glucosyltransferase"
MHHHHEGVSDQTLRVLMFPWLALGHVNPFLRIAKQLADRGFVIYLVSTAINLNSIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKLLRARREEEMNAAAEELIQLCRNRNAYK

SEQ ID NO: 7833 - DNA, 1350 bp, Artificial Sequence
  "Variant of ADP-beta-1,3-glucosyltransferase"
atgcaccatcatcatgaaggcgtgagcggtcagaccctgagagtactgatgtttccgtggcttgcgctgggtcatgttaacccgtttttgcgtatcgctaaacaactggccgatcgtggtttcgttatctatttagttagtaccgctattaacctcaatagcatcaaaaagagaatcccggagaaatacagtaatagtatccatctggttgagctggcgctgccagaattaccggaactgccaccacattaccatactaccaacggtttaccaccgcatctgaacgggaccctgcataaggcactgaagatgagcgctcccaactttagcaagatccttcaaaacctgaagccggacctggtcctttacgattttctgcagccgtgggcagagggtgtcgcccttaggcagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagccactggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgttcgtgatgaagatggccggattcaccgcggcgaaattgcccaagtcctgaaagatgtgatttcgggcccgactggtgagatcctgcgcgcgaaagtacgcgacattagcaaactgctgagagcgagccgcgaggaggaaatgaacgcagcggcggaagaactgatacagctgtgtcgcaaccgcaacgcctacaag

SEQ ID NO: 7834 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLNSIKKRIPEKYSNSIHLVELALPELPELPPHYHTTNGLPPHLNGTLHKALKMSAPNFSKILQNLKPDLVLYDFLQPWAEGVALRQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQPLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKLLRASREEEMNAAAEELIQLCRNRNAYK

SEQ ID NO: 7835 - DNA, 1350 bp, Artificial Sequence
  "Variant of ADP-beta-1,3-glucosyltransferase"
atgcaccatcatcatgaaggcgtgagcgatcagaccctgagagtactgatgtttccgtggcttgcgctgggtcatgttaacccgtttttgcgtatcgctaaacaactggccgatcgtggtttcgttatctatttagttagtaccgctattaacctcgagagcatcaaaaagagaatcccggagaaatacagtaatagcatccatctggttgagctggcgctgccagaattaccggaactgccaccacattaccatactaccaacggtttaccaccgcatctgaacgggaccctgcataaggcactgaagatgagcgctcccaactttagcaagatccttcaaaacctgaagccggacctggtcctttacgattttctgcagccgtgggcagagagggtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagccactggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccacgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7836 - protein, 450 aa, Artificial Sequence
  "Variant of ADP-beta-1,3-glucosyltransferase"
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAERVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQPLEDVLPKGFLERVGDRGRVLDHLVPQAHILNHPSTGGFISHCGWNSVMESIDFGVPIIAMPMQWDQPINARLLVELGVAVEIPRDEDGRIHRGEIAQVLKDVISGPTGEILRAKVRDISKRLRARREEEMNAAAEELIQLCRNRNAYK

SEQ ID NO: 7837 - DNA, 1350 bp, Artificial Sequence
  "Variant of ADP-beta-1,3-glucosyltransferase"
atgcaccatcatcatgaaggcgtgagcgatcagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgttcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7838 - protein, 450 aa, Artificial Sequence
  "Variant of ADP-beta-1,3-glucosyltransferase"
MHHHHEGVSDQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 7839 - DNA, 1350 bp, Artificial Sequence
  "Variant of ADP-beta-1,3-glucosyltransferase"
atgcaccatcatcatgaaggcgtgagcggtcagaccctgagagtactgatgtttccgtggcttgcgctgggtcatgttaacccgtttttgcgtatcgctaaacaactggccgatcgtggtttcgttatctatttagttagtaccgctattaacctcgagagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcagccgtgggcagagggtgtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgcgggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgttcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7840 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEGVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 7841 - DNA, 1350 bp, Artificial Sequence
  "Variant of ADP-beta-1,3-glucosyltransferase"
atgcaccatcatcatgaaggcgtgagcggtcagaccctgagagtactgatgtttccgtggcttgcgctgggtcatgttaacccgtttttgcgtatcgctaaacaactggccgatcgtggtttcgttatctatttagttagtaccgctattaacctcgagagcatcaaaaagagaatcccggagaaatacagtaatagcatccatctggttgagctgcacctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatctcacgtgatgaagatggccggattcaccgcggcgaaattgcccaagtcctgaaagatgtgatttcgggcccgactggtgagatcctgcgcgcgaaagtacgcgacattagcaaacggctgagagcgagccgcgaggaggaaatgaacgcagcggcggaagaactgatacagctgtgtcgcaaccgcaacgcctacaag

SEQ ID NO: 7842 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELHLPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEISRDEDGRIHRGEIAQVLKDVISGPTGEILRAKVRDISKRLRASREEEMNAAAEELIQLCRNRNAYK

SEQ ID NO: 7843 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcacctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgttcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7844 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELHLPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 7845 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgagagcatcaaaaagagaatcccggagaaatacagtaatagcatccatctggttgagctggcactgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatctcacgtgatgaagatggccggattcaccgcggcgaaattgcccaagtcctgaaagatgtgatttcgggcccgactggtgagatcctgcgcgcgaaagtacgcgacattagcaaacgcctgagagcgagccgcgaggaggaaatgaacgcagcggcggaagaactgatacagctgtgtcgcaaccgcaacgcctacaag

SEQ ID NO: 7846 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEISRDEDGRIHRGEIAQVLKDVISGPTGEILRAKVRDISKRLRASREEEMNAAAEELIQLCRNRNAYK

SEQ ID NO: 7847 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagccactggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatctcacgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7848 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQPLEDVLPKGFLERVGDRGRVLDHLVPQAHILNHPSTGGFISHCGWNSVMESIDFGVPIIAMPMQWDQPINARLLVELGVAVEISRDEDGRIHRGEIAQVLKDVISGPTGEILRAKVRDISKRLRARREEEMNAAAEELIQLCRNRNAYK

SEQ ID NO: 7849 - DNA, 1350 bp, Artificial Sequence
  "Variant of ADP-beta-1,3-glucosyltransferase"
atgcaccatcatcatgaaggcgtgagcgatcagaccctgagagtactgatgtttccgtggcttgcgctgggtcatgttaacccgtttttgcgtatcgctaaacaactggccgatcgtggtttcgttatctatttagttagtaccgctattaacctcaatagcatcaaaaagagaatcccggagaaatacagtaatagcatccatctggttgagctggcactgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccatgaagatatggaagaagtcgcgttcggcctggagctgagcaacgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgttcgtgatgaagatggccggattcaccgcggcgaaattgcccaagtcctgaaagatgtgatttcgggcccgactggtgagatcctgcgcgcgaaagtacgcgacattagcaaactgctgagagcgagccgcgaggaggaaatgaacgcagcggcggaagaactgatacagctgtgtcgcaaccgcaacgcctacaag

SEQ ID NO: 7850 - protein, 450 aa, Artificial Sequence
  "Variant of ADP-beta-1,3-glucosyltransferase"
MHHHHEGVSDQTLRVLMFPWLALGHVNPFLRIAKQLADRGFVIYLVSTAINLNSIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSHEDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKLLRASREEEMNAAAEELIQLCRNRNAYK

SEQ ID NO: 7851 - DNA, 1350 bp, Artificial Sequence
  "Variant of ADP-beta-1,3-glucosyltransferase"
atgcaccatcatcatgaaggcgtgagcggtcagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgattccgtgggcagagaaggtcgcccttgaacaggggatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgttcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7852 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLIPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 7853 - DNA, 1350 bp, Artificial Sequence
  "Variant of ADP-beta-1,3-glucosyltransferase"
atgcaccatcatcatgaaggcgtgagcggtcagaccctgagagtactgatgtttccgtggcttgcgctgggtcatgttaacccgtttttgcgtatcgctaaacaactggccgatcgtggtttcgttatctatttagttagtaccgctattaacctcaatagcatcaaaaagagaatcccggagaaatacagtaatagcatccatctggttgagctggcactgccagaattaccggaactgccaccacattaccatactaccaacggtttaccaccgcatctgaacgggaccctgcataaggcactgaagatgagcgctcccaactttagcaagatccttcaaaacctgaagccggacctggtcctttacgattttctgattccgtgggcagagagggtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatctcacgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7854 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLNSIKKRIPEKYSNSIHLVELALPELPELPPHYHTTNGLPPHLNGTLHKALKMSAPNFSKILQNLKPDLVLYDFLIPWAERVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEISRDEDGRIHRGEIAQVLKDVISGPTGEILRAKVRDISKRLRARREEEMNAAAEELIQLCRNRNAYK

SEQ ID NO: 7855 - DNA, 1350 bp, Artificial Sequence
  "Variant of ADP-beta-1,3-glucosyltransferase"
atgcaccatcatcatgaaggcgtgagcggtcagaccctgagagtactgatgtttccgtggcttgcgctgggtcatgttaacccgtttttgcgtatcgctaaacaactggccgatcgtggtttcgttatctatttagttagtaccgctattaacctcgagagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaacacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatctcacgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7856 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPEHSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEISRDEDGRIHRGEIAQVLKDVISGPTGEILRAKVRDISKRLRARREEEMNAAAEELIQLCRNRNAYK

SEQ ID NO: 7857 - DNA, 1350 bp, Artificial Sequence
  "Variant of ADP-beta-1,3-glucosyltransferase"
atgcaccatcatcatgaaggcgtgagcggtcagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcactgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcagccgtgggcagagaaggtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagccactggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccacgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7858 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQPLEDVLPKGFLERVGDRGRVLDHLVPQAHILNHPSTGGFISHCGWNSVMESIDFGVPIIAMPMQWDQPINARLLVELGVAVEIPRDEDGRIHRGEIAQVLKDVISGPTGEILRAKVRDISKRLRARREEEMNAAAEELIQLCRNRNAYK

SEQ ID NO: 7859 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcaatagcatcaaaaagagaatcccggagaaatacagtaatagcatccatctggttgagctgcacctgccagaattaccggaactgccaccacattaccatactaccaacggtttaccaccgcatctgaacgggaccctgcataaggcactgaagatgagcgctcccaactttagcaagatccttcaaaacctgaagccggacctggtcctttacgattttctgcagccgtgggcagagaaggtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaattcgggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgttcgtgatgaagatggccggattcaccgcggcgaaattgcccaagtcctgaaagatgtgatttcgggcccgactggtgagatcctgcgcgcgaaagtacgcgacattagcaaactgctgagagcgcgccgcgaggaggaaatgaacgcagcggcggaagaactgatacagctgtgtcgcaaccgcaacgcctacaag

SEQ ID NO: 7860 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLNSIKKRIPEKYSNSIHLVELHLPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNSGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKLLRARREEEMNAAAEELIQLCRNRNAYK

SEQ ID NO: 7861 - DNA, 1350 bp, Artificial Sequence
  "Variant of ADP-beta-1,3-glucosyltransferase"
atgcaccatcatcatgaaggcgtgagcggtcagaccctgagagtactgatgtttccgtggcttgcgctgggtcatgttaacccgtttttgcgtatcgctaaacaactggccgatcgtggtttcgttatctatttagttagtaccgctattaacctcgagagcatcaaaaagagaatcccggagaaatacagtaatagcatccatctggttgagctgcacctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcagccgtgggcagagagggtcgcccttaggcagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatctcacgtgatgaagatggccggattcaccgcggcgaaattgcccaagtcctgaaagatgtgatttcgggcccgactggtgagatcctgcgcgcgaaagtacgcgacattagcaaacggctgagagcgagccgcgaggaggaaatgaacgcagcggcggaagaactgatacagctgtgtcgcaaccgcaacgcctacaag

SEQ ID NO: 7862 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELHLPELPELPPHYHTTNGLPPHLNGTLHKALKMSAPNFSKILQNLKPDLVLYDFLQPWAERVALRQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEISRDEDGRIHRGEIAQVLKDVISGPTGEILRAKVRDISKRLRASREEEMNAAAEELIQLCRNRNAYK

SEQ ID NO: 7863 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcataaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatctcacgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7864 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEISRDEDGRIHRGEIAQVLKDVISGPTGEILRAKVRDISKRLRARREEEMNAAAEELIQLCRNRNAYK

SEQ ID NO: 7865 - DNA, 1350 bp, Artificial Sequence
  "Variant of ADP-beta-1,3-glucosyltransferase"
atgcaccatcatcatgaaggcgtgagcgatcagaccctgagagtactgatgtttccgtggcttgcgctgggtcatgttaacccgtttttgcgtatcgctaaacaactggccgatcgtggtttcgttatctatttagttagtaccgctattaacctcgagagcatcaaaaagagaatcccggagaaatacagtaatagcatccatctggttgagctgcacctgccagaattaccggaactgccaccacattaccatactaccaacggtttaccaccgcatctgaacgggaccctgcataaggcactgaagatgagcgctcccaactttagcaagatccttcaaaacctgaagccggacctggtcctttacgattttctgattccgtgggcagagaaggtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgcgggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgttcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7866 - protein, 450 aa, Artificial Sequence
  "Variant of ADP-beta-1,3-glucosyltransferase"
MHHHHEGVSDQTLRVLMFPWLALGHVNPFLRIAKQLADRGFVIYLVSTAINLESIKKRIPEKYSNSIHLVELHLPELPELPPHYHTTNGLPPHLNGTLHKALKMSAPNFSKILQNLKPDLVLYDFLIPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 7867 - DNA, 1350 bp, Artificial Sequence
  "Variant of ADP-beta-1,3-glucosyltransferase"
atgcaccatcatcatgaagtcgtgagcgatcagaccctgagagtactgatgtttccgtggcttgcgctgggtcatgttaacccgtttttgcgtatcgctaaacaactggccgatcgtggtttcgttatctatttagttagtaccgctattaacctcgagagcatcaaaaagagaatcccggagaaatacagtaatagcatccatctggttgagctgcacctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgattccgtgggcagagggtgtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgcgggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaacctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcccacgtgatgaagatggccggattcaccgcggcgaaattgcccaagtcctgaaagatgtgatttcgggcccgactggtgagatcctgcgcgcgaaagtacgcgacattagcaaactgctgagagcgcgccgcgaggaggaaatgaacgcagcggcggaagaactgatacagctgtgtcgcaaccgcaacgcctacaag

SEQ ID NO: 7868 - protein, 450 aa, Artificial Sequence
  "Variant of ADP-beta-1,3-glucosyltransferase"
MHHHHEVVSDQTLRVLMFPWLALGHVNPFLRIAKQLADRGFVIYLVSTAINLESIKKRIPEKYSNSIHLVELHLPELPELPPHYHTTNGLPPHLNGTLHKALKMSAPNFSKILQNLKPDLVLYDFLIPWAEGVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIPRDEDGRIHRGEIAQVLKDVISGPTGEILRAKVRDISKLLRARREEEMNAAAEELIQLCRNRNAYK

SEQ ID NO: 7869 - DNA, 1350 bp, Artificial Sequence
  "Variant of ADP-beta-1,3-glucosyltransferase"
atgcaccatcatcatgaaggcgtgagcggtcagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcactgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaactgctgagagcgagccgcgaggaggaaatgaacgcagcggcggaagaactgatacagctgtgtcgcaaccgcaacgcctacaag

SEQ ID NO: 7870 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKLLRASREEEMNAAAEELIQLCRNRNAYK

SEQ ID NO: 7871 - DNA, 1350 bp, Artificial Sequence
  "Variant of ADP-beta-1,3-glucosyltransferase"
atgcaccatcatcatgaaggcgtgagcggtcagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaattcgggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7872 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNSGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 7873 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctgcacctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatctcacgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7874 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELHLPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEISRDEDGRIHRGEIAQVLKDVISGPTGEILRAKVRDISKRLRARREEEMNAAAEELIQLCRNRNAYK

SEQ ID NO: 7875 - DNA, 1350 bp, Artificial Sequence
  "Variant of ADP-beta-1,3-glucosyltransferase"
atgcaccatcatcatgaaggcgtgagcggtcagaccctgagagtactgatgtttccgtggcttgcgctgggtcatgttaacccgtttttgcgtatcgctaaacaactggccgatcgtggtttcgttatctatttagttagtaccgctattaacctcaatagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgattccgtgggcagagaaggtcgcccttaggcagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatccttcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7876 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLNSIKKRIPEKYSNSIHLVELALPELPELPPHYHTTNGLPPHLNGTLHKALKMSAPNFSKILQNLKPDLVLYDFLIPWAEKVALRQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEILRDEDGRIHRGEIAQVLKDVISGPTGEILRAKVRDISKRLRARREEEMNAAAEELIQLCRNRNAYK

SEQ ID NO: 7877 - DNA, 1350 bp, Artificial Sequence
  "Variant of ADP-beta-1,3-glucosyltransferase"
atgcaccatcatcatgaaggcgtgagcggtcagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgcgggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccatgaagatatggaagaagtcgcgttcggcctggagctgagcaacgtgaactttatctgggttgcacgctttccgaaaggcgaagaacagccactggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7878 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSHEDMEEVAFGLELSNVNFIWVARFPKGEEQPLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 7879 - DNA, 1350 bp, Artificial Sequence
  "Variant of ADP-beta-1,3-glucosyltransferase"
atgcaccatcatcatgaaggcgtgagcggtcagaccctgagagtactgatgtttccgtggcttgcgctgggtcatgttaacccgtttttgcgtatcgctaaacaactggccgatcgtggtttcgttatctatttagttagtaccgctattaacctcaatagcatcaaaaagagaatcccggagaaatacagtaatagcatccatctggttgagctggcgctgccagaattaccggaactgccaccacattaccatactaccaacggtttaccaccgcatctgaacgggaccctgcataaggctctgaagatgagcgctcccaactttagcaagatccttcaaaacctgaagccggacctggtcctttacgattttctgcaaccgtgggcagagggtgtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagccactggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatctcacgtgatgaagatggccggattcaccgcggcgaaattgcccaagtcctgaaagatgtgatttcgggcccgactggtgagatcctgcgcgcgaaagtacgcgacattagcaaactgctgagagcgagccgcgaggaggaaatgaacgcagcggcggaagaactgatacagctgtgtcgcaaccgcaacgcctacaag

SEQ ID NO: 7880 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLNSIKKRIPEKYSNSIHLVELALPELPELPPHYHTTNGLPPHLNGTLHKALKMSAPNFSKILQNLKPDLVLYDFLQPWAEGVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQPLEDVLPKGFLERVGDRGRVLDHLVPQAHILNHPSTGGFISHCGWNSVMESIDFGVPIIAMPMQWDQPINARLLVELGVAVEISRDEDGRIHRGEIAQVLKDVISGPTGEILRAKVRDISKLLRASREEEMNAAAEELIQLCRNRNAYK

SEQ ID NO: 7881 - DNA, 1350 bp, Artificial Sequence
  "Variant of ADP-beta-1,3-glucosyltransferase"
atgcaccatcatcatgaaggcgtgagcggtcagaccctgagagtactgatgtttccgtggcttgcgctgggtcatgttaacccgtttttgcgtatcgctaaacaactggccgatcgtggtttcgttatctatttagttagtaccgctattaacctcgagagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaattcgggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatctcacgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7882 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNSGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEISRDEDGRIHRGEIAQVLKDVISGPTGEILRAKVRDISKRLRARREEEMNAAAEELIQLCRNRNAYK

SEQ ID NO: 7883 - DNA, 1350 bp, Artificial Sequence
  "Variant of ADP-beta-1,3-glucosyltransferase"
atgcaccatcatcatgaaggcgtgagcgatcagaccctgagagtactgatgtttccgtggcttgcgctgggtcatgttaacccgtttttgcgtatcgctaaacaactggccgatcgtggtttcgttatctatttagttagtaccgctattaacctcaatagcatcaaaaagagaatcccggagaaatacagtaatagcatccatctggttgagctgcacctgccagaattaccggaactgccaccacattaccatactaccaacggtttaccaccgcatctgaacgggaccctgcgtaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7884 - protein, 450 aa, Artificial Sequence
  "Variant of ADP-beta-1,3-glucosyltransferase"
MHHHHEGVSDQTLRVLMFPWLALGHVNPFLRIAKQLADRGFVIYLVSTAINLNSIKKRIPEKYSNSIHLVELHLPELPELPPHYHTTNGLPPHLNGTLRKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 7885 - DNA, 1350 bp, Artificial Sequence
  "Variant of ADP-beta-1,3-glucosyltransferase"
atgcaccatcatcatgaaggcgtgagcggtcagaccctgagagtactgatgtttccgtggcttgcgctgggtcatgttaacccgtttttgcgtatcgctaaacaactggccgatcgtggtttcgttatctatttagttagtaccgctattaacctcgagagcatcaaaaagagaatcccggagaaatacagtaatagcatccatctggttgagctgcacctgccagaattaccggaactgccaccacattaccatactaccaacggtttaccaccgcatctgaacgggaccctgcataaggcactgaagatgagcgctcccaactttagcaagatccttcaaaacctgaagccggacctggtcctttacgattttctgattccgtgggcagagaaggtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgcgggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacggctgagagcgagccgcgaggaggaaatgaacgcagcggcggaagaactgatacagctgtgtcgcaaccgcaacgcctacaag

SEQ ID NO: 7886 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELHLPELPELPPHYHTTNGLPPHLNGTLHKALKMSAPNFSKILQNLKPDLVLYDFLIPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRASREEEMNAAAEELIQLCRNRNAYK

SEQ ID NO: 7887 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttcccgttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcatggaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggggaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaagcgcaatgcctataag

SEQ ID NO: 7888 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCMELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRKRNAYK

SEQ ID NO: 7889 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtgggagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttcccgttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgccaagaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaggcgcaatgccaagaag

SEQ ID NO: 7890 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSGSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCQELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRRRNAKK

SEQ ID NO: 7891 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaatgccctcaag

SEQ ID NO: 7892 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNALK

SEQ ID NO: 7893 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttcccgttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgccaaagtcctgaaagatgtgattggcggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7894 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAKVLKDVIGGPTGEILRAKVRDISKRLRARREEEMNAAAEELIQLCRNRNAYK

SEQ ID NO: 7895 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgcccccaactttagcaagatccttcaaaacctgaagccggacctggtcctttacgattttctgcaaccgtgggcagaaaaagtcgcccttgaacagggcatcccggctgttcccgttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgccaaagtcctgaaagatgtgattggcggcccgactggtgagatcctgcgcgcgaaagtacgcgacattagcaaacgcctgagagcgagacgcgaggaggaaatgaacgcagcggcggaagaactgatacagctgtgtcgcaaccgcaatgccctcaag

SEQ ID NO: 7896 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAKVLKDVIGGPTGEILRAKVRDISKRLRARREEEMNAAAEELIQLCRNRNALK

SEQ ID NO: 7897 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgcccccaactttagcaagatccttcaaaacctgaagccggacctggtcctttacgattttctgcaaccgtgggcagaaaaagtcgcccttgaacagggcatcccggctgttaaagttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcacggaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccacccggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattagcggcccgactggtgagatcctgcgcgcgaaagtacgcgacattagcaaacgcctgagagcgagacgcgaggaggaaatgaacgcagcggcggaagaactgatacagctgtgtcgcaagcgcttagccctcaag

SEQ ID NO: 7898 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVKVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPPGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRKRLALK

SEQ ID NO: 7899 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtgggagcatccatctggttgagctggcgctgccagaattaccggaactgccaccacattaccatactaccaacggtttaccaccgcatctgaacgggaccctgcacaaggcactgaagatgagcgcccccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgagagatgtgattggcggcccgactggtgagatcctgcgcgcgaaagtacgcgacattagcaaacgcctgagagcgagacgcgaggaggaaatgaacgcagcggcggaagaactgatacagctgtgtcgcaggcgcaatgccaggaag

SEQ ID NO: 7900 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSGSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLRDVIGGPTGEILRAKVRDISKRLRARREEEMNAAAEELIQLCRRRNARK

SEQ ID NO: 7901 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgcccccaactttagcaagatccttcaaaacctgaagccggacctggtcctttacgattttctgcaaccgtgggcagaaaaagtcgcccttgaacagggcatcccggctgttaaagttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccacccggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggggaaattgcccaagtcctgagagatgtgattagcggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7902 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVKVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPPGFLERVGDRGRVLDHLVPQAHILNHPSTGGFISHCGWNSVMESIDFGVPIIAMPMQWDQPINARLLVELGVAVEIVRDEDGRIHRGEIAQVLRDVISGPTGEILRAKVRDISKRLRARREEEMNAAAEELIQLCRNRNAYK

SEQ ID NO: 7903 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtgggagcatccatctggttgagctggcgctgccagaattaccggaactgccaccacattaccatactaccaacggtttaccaccgcatctgaacgggaccctgcacaaggcactgaagatgagcgcccccaactttagcaagatccttcaaaacctgaagccggacctggtcctttacgattttctgcaaccgtgggcagaaaaagtcgcccttgaacagggcatcccggctgttcccgttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgccaaagtcctgaaagatgtgattggcggcccgactggtgagatcctgcgcgcgaaagtacgcgacattagcaaacgcctgagagcgagacgcgaggaggaaatgaacgcagcggcggaagaactgatacagctgtgtcgcaaccgcttagccaggaag

SEQ ID NO: 7904 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSGSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAKVLKDVIGGPTGEILRAKVRDISKRLRARREEEMNAAAEELIQLCRNRLARK

SEQ ID NO: 7905 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgccaagaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaagcgcttagcctataag

SEQ ID NO: 7906 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCQELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRKRLAYK

SEQ ID NO: 7907 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttcccgttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaagcgcaatgccctcaag

SEQ ID NO: 7908 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRKRNALK

SEQ ID NO: 7909 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgcccccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccacccggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggggaaattgccaaagtcctgaaagatgtgattagcggcccgactggtgagatcctgcgcgcgaaagtacgcgacattagcaaacgcctgagagcgagacgcgaggaggaaatgaacgcagcggcggaagaactgatacagctgtgtcgcaaccgcaatgccctcaag

SEQ ID NO: 7910 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPPGFLERVGDRGRVLDHLVPQAHILNHPSTGGFISHCGWNSVMESIDFGVPIIAMPMQWDQPINARLLVELGVAVEIVRDEDGRIHRGEIAKVLKDVISGPTGEILRAKVRDISKRLRARREEEMNAAAEELIQLCRNRNALK

SEQ ID NO: 7911 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcacggaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaggcgcaatgccctcaag

SEQ ID NO: 7912 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRRRNALK

SEQ ID NO: 7913 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgcccccaactttagcaagatccttcaaaacctgaagccggacctggtcctttacgattttctgcaaccgtgggcagaaaaagtcgcccttgaacagggcatcccggctgttcccgttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcacggaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattggcggcccgactggtgagatcctgcgcgcgaaagtacgcgacattagcaaacgcctgagagcgagacgcgaggaggaaatgaacgcagcggcggaagaactgatacagctgtgtcgcaggcgcaatgccaagaag

SEQ ID NO: 7914 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVIGGPTGEILRAKVRDISKRLRARREEEMNAAAEELIQLCRRRNAKK

SEQ ID NO: 7915 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaggcgcttagccctcaag

SEQ ID NO: 7916 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRRRLALK

SEQ ID NO: 7917 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtgggagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcacggaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaagcgcttagccaggaag

SEQ ID NO: 7918 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSGSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRKRLARK

SEQ ID NO: 7919 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttcccgttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggggaaattgcccaagtcctgaaagatgtgattggcggcccgactggtgagatcctgcgcgcgaaagtacgcgacattagcaaacgcctgagagcgagacgcgaggaggaaatgaacgcagcggcggaagaactgatacagctgtgtcgcaggcgcttagccctcaag

SEQ ID NO: 7920 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVIGGPTGEILRAKVRDISKRLRARREEEMNAAAEELIQLCRRRLALK

SEQ ID NO: 7921 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgcccccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggggaaattgcccaagtcctgaaagatgtgattggcggcccgactggtgagatcctgcgcgcgaaagtacgcgacattagcaaacgcctgagagcgagacgcgaggaggaaatgaacgcagcggcggaagaactgatacagctgtgtcgcaagcgcaatgccaggaag

SEQ ID NO: 7922 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVIGGPTGEILRAKVRDISKRLRARREEEMNAAAEELIQLCRKRNARK

SEQ ID NO: 7923 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtgggagcatccatctggttgagctggcgctgccagaattaccggaactgccaccacattaccatactaccaacggtttaccaccgcatctgaacgggaccctgcacaaggcactgaagatgagccgccccaactttagcaagatccttcaaaacctgaagccggacctggtcctttacgattttctgcaaccgtgggcagaaaaagtcgcccttgaacagggcatcccggctgttcccgttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggggaaattgcccaagtcctgaaagatgtgattagcggcccgactggtgagatcctgcgcgcgaaagtacgcgacattagcaaacgcctgagagcgagacgcgaggaggaaatgaacgcagcggcggaagaactgatacagctgtgtcgcaagcgcttagccctcaag

SEQ ID NO: 7924 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSGSIHLVELALPELPELPPHYHTTNGLPPHLNGTLHKALKMSRPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRKRLALK

SEQ ID NO: 7925 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgcccccaactttagcaagatccttcaaaacctgaagccggacctggtcctttacgattttctgcaaccgtgggcagaaaaagtcgcccttgaacagggcatcccggctgttaaagttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgccaagaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaagcgcttagcctataag

SEQ ID NO: 7926 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVKVLTSGAALFSYFFNFLKRPGHEFPFPAIRLSKREQDKMREMFGTEPDEEDPLAPGNAGIMLMCTSRVIEAKYLDYCQELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRKRLAYK

SEQ ID NO: 7927 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgcccccaactttagcaagatccttcaaaacctgaagccggacctggtcctttacgattttctgcaaccgtgggcagaaaaagtcgcccttgaacagggcatcccggctgttcccgttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggggaaattgcccaagtcctgagagatgtgattagcggcccgactggtgagatcctgcgcgcgaaagtacgcgacattagcaaacgcctgagagcgagacgcgaggaggaaatgaacgcagcggcggaagaactgatacagctgtgtcgcaggcgcaatgccctcaag

SEQ ID NO: 7928 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLRDVISGPTGEILRAKVRDISKRLRARREEEMNAAAEELIQLCRRRNALK

SEQ ID NO: 7929 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtgggagcatccatctggttgagctggcgctgccagaattaccggaactgccaccacattaccatactaccaacggtttaccaccgcatctgaacgggaccctgcacaaggcactgaagatgagcgcccccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgccaagaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccacccggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaggcgcttagcctataag

SEQ ID NO: 7930 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSGSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCQELTNVKVVPVGPPFQDPMTEDIDDKELIDWLDTKPENSVVYVSFGSEYFLSREDMEEVAFGLELSNVNFIWVARFPKGEEQNLEDVLPPGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRRRLAYK

SEQ ID NO: 7931 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagccgccccaactttagcaagatccttcaaaacctgaagccggacctggtcctttacgattttctgcaaccgtgggcagaaaaagtcgcccttgaacagggcatcccggctgttcccgttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgccaagaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgccaaagtcctgagagatgtgattggcggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7932 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSRPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCQELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAKVLRDVIGGPTGEILRAKVRDISKRLRARREEEMNAAAEELIQLCRNRNAYK

SEQ ID NO: 7933 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtgggagcatccatctggttgagctggcgctgccagaattaccggaactgccaccacattaccatactaccaacggtttaccaccgcatctgaacgggaccctgcacaaggcactgaagatgagcgcccccaactttagcaagatccttcaaaacctgaagccggacctggtcctttacgattttctgcaaccgtgggcagaaaaagtcgcccttgaacagggcatcccggctgttcccgttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcacggaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattagcggcccgactggtgagatcctgcgcgcgaaagtacgcgacattagcaaacgcctgagagcgagacgcgaggaggaaatgaacgcagcggcggaagaactgatacagctgtgtcgcaaccgcttagccctcaag

SEQ ID NO: 7934 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSGSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRLALK

SEQ ID NO: 7935 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattagcggcccgactggtgagatcctgcgcgcgaaagtacgcgacattagcaaacgcctgagagcgagacgcgaggaggaaatgaacgcagcggcggaagaactgatacagctgtgtcgcaaccgcttagcctataag

SEQ ID NO: 7936 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRLAYK

SEQ ID NO: 7937 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttcccgttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccacccggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaagcgcttagccctcaag

SEQ ID NO: 7938 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPPGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRKRLALK

SEQ ID NO: 7939 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtgggagcatccatctggttgagctggcgctgccagaattaccggaactgccaccacattaccatactaccaacggtttaccaccgcatctgaacgggaccctgcacaaggcactgaagatgagcgcccccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgccaagaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaggcgcaatgccaggaag

SEQ ID NO: 7940 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSGSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCQELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRRRNARK

SEQ ID NO: 7941 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgccaagaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgccaaagtcctgaaagatgtgattagcggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7942 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCQELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAKVLKDVISGPTGEILRAKVRDISKRLRARREEEMNAAAEELIQLCRNRNAYK

SEQ ID NO: 7943 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtgggagcatccatctggttgagctggcgctgccagaattaccggaactgccaccacattaccatactaccaacggtttaccaccgcatctgaacgggaccctgcacaaggcactgaagatgagcgcccccaactttagcaagatccttcaaaacctgaagccggacctggtcctttacgattttctgcaaccgtgggcagaaaaagtagcccttgaacagggcatcccggctgttaaagttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgccaagaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 7944 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSGSIHLVELALPELPELPPHYHTTNGLPPHLNGTLHKALKMSAPNFSKILQNLKPDLVLYDFLQPWAEKVALEQGIPAVKVLTSGAALFSYFFNFLKRPGHEFPFPAIRLSKREQDKMREMFGTEPDEEDPLAPGNAGIMLMCTSRVIEAKYLDYCQELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 7945 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtaagagaatcccgcagattaacaagcacggcgcggatgaattccgtaaagagctggaaagcgcgatgcgggatagcccgtcggacgaggaagttgcgtgcctgattaccgatgcgctgtggtacttcgcgcaaccggtggcggacagcctgaatctgaaacgtctggttctgcaaaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaatggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 7946 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTHGPGAGKRIPQINKHGADEFRKELESAMRDSPSDEEVACLITDALWYFAQPVADSLNLKRLVLQTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7947 - DNA, 1371 bp, Artificial Sequence
  "Variant of ADP-beta-1,3-glucosyltransferase"
atgccaaacacaagccccaccaccgttcgtcgtcgtcgtgttattctgtttccggttccgttcccgggccacttaaacccgatgctgcaactggcgaacgtgctgtaccgtagaggttttgcgatcaccattctgcacaccaacttcaacgccccggaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgtcggacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgttcagcgggaaattccggcgccgagcttcctgcttccgctgccgaagcattatagggcgagcagcagcagcctgctggatgaagatccgagcgtggcccaatggctggaccggcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaaattctgcatgtgggcattacgctggagaatggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 7948 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPETSLYPHFSFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVQREIPAPSFLLPLPKHYRASSSSLLDEDPSVAQWLDRQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEILHVGITLENGFERGEIVNAIRRVMVDPEGEVMRQNARKLKDKLDRSIAPGGSSYESLERLVSYISSL

SEQ ID NO: 7949 - DNA, 1371 bp, Artificial Sequence
  "Variant of ADP-beta-1,3-glucosyltransferase"
atgccaaacacaagccccaccaccggtcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgcaaaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 7950 - protein, 457 aa, Artificial Sequence
  "Variant of ADP-beta-1,3-glucosyltransferase"
MPNTSPTTGRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACLITDALWYFAQPVADSLNLKRLVLQTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKQSFLWRVRPGFVKGYEWIELLPDGFLGERGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7951 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgcagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtaagagaatcccgcagattaacaagcacggcgcggatgaattccgtaaagagctggaaagcgcgatgcgggatagcccgtcggacgaggaagttgcgtgcctgattaccgatgcgctgtggtacttcgcgcaaccggtggcggacagcctgaatctgaaacgtctggttctgcaaaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgttacgctggagaatggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 7952 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTHGPGAGKRIPQINKHGADEFRKELESAMRDSPSDEEVACLITDALWYFAQPVADSLNLKRLVLQTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVTLENGFERGEIVNAIRRVMVDPEGEVMRQNARKLKDKLDRSIAPGGSSYESLERLVSYISSL

SEQ ID NO: 7953 - DNA, 1371 bp, Artificial Sequence
  "Variant of ADP-beta-1,3-glucosyltransferase"
atgccaaacacaagccccaccaccgttcgtcgtcgtcgtgttattctgtttccggttccgttcccgggccacttaaacccgatgctgcaactggcgaacgtgctgtaccgcagaggttttgcgatcaccattctgcacaccaacttcaacgccccggaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgtcggacgaggaagttgcgtgcctgattaccgatgcgctgtggtacttcgcgcaaccggtggcggacagcctgaatctgaaacgtctggttctgcaaaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgttcagcgggaaattccggcgccgagcttcctgcttccgctgccgaagcattatagggcgagcagcagcagcctgctggatgaagatccgagcgtggcccaatggctggaccggcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttacctggagaatggcttcgagcgtggtgaaatcgtaaacgcgattaggcgtgtgatggttgacccggaaggtgaggttatgcgtcaaaacgcgcgtatattgaaggataagttggatcgaagcattgctcccggtggcagcagctacgagagcctggaacgcctggttagctatattagcagcctg

SEQ ID NO: 7954 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPETSLYPHFSFRFILDNDPQTEWLRNLPTHGPGAGMRIPQINKHGADEFRKELESAMRDSPSDEEVACLITDALWYFAQPVADSLNLKRLVLQTSSLFNFHALVCLPQFLELGYLDPEDKHRPEEPVVGFPMLKVKDIRRAYSHWQEAKPILDKMIEETRASSGVIWNSFKELEESELETVQREIPAPSFLLPLPKHYRASSSSLLDEDPSVAQWLDRQPPSSVLYVGFGSQSEVDPKDFLEIARGLVDSKQSFLWRVRPGFVKGYEWIELLPDGFLGERGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARILKDKLDRSIAPGGSSYESLERLVSYISSL

SEQ ID NO: 7955 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccggcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 7956 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDRQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7957 - DNA, 1371 bp, Artificial Sequence
  "Variant of ADP-beta-1,3-glucosyltransferase"
atgccaaacacaagccccaccaccgttcgtcgtcgtcgtgttattctgtttccggttccgttcccgggccacttaaacccgatgctgcaactggcgaacgtgctgtacagcagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttcgcgggaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 7958 - protein, 457 aa, Artificial Sequence
  "Variant of ADP-beta-1,3-glucosyltransferase"
MPNTSPTTVRRRRVILFPVPFPGHLNPMLQLANVLYSRGFAITILHTNFNAPKTSLYPHFSFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVSREIPAPSFLLPLPKHYRASSSSLLDEDPSVAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7959 - DNA, 1371 bp, Artificial Sequence
  "Variant of ADP-beta-1,3-glucosyltransferase"
atgccaaacacaagccccaccaccgttcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgcttctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgttcagaatgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagctgctgccggatggttttctgggtgaaagaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtatattgaaggataagttggatcgaagcattgctcccggtggcagcagctacgagagcctggaacgcctggttagctatattagcagcctg

SEQ ID NO: 7960 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPLLKVKDIRRAYSHWQEAKPILDKMIEETRASSGVIWNSFKELEESELETVQNEIPAPSFLLPLPKHYRASSSSLLDEDPSVAQWLDQQPPSSVLYVGFGSQSEVDPKDFLEIARGLVDSKQSFLWRVRPGFVKGYEWIELLPDGFLGERGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARILKDKLDRSIAPGGSSYESLERLVSYISSL

SEQ ID NO: 7961 - DNA, 1371 bp, Artificial Sequence
  "Variant of ADP-beta-1,3-glucosyltransferase"
atgccaaacacaagccccaccaccggtcgtcgtcgtcgtgttattctgtttccggttccgttcccgggccacttaaacccgatgctgcaactggcgaacgtgctgtacagcagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccggatgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgttacgctggagaatggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 7962 - protein, 457 aa, Artificial Sequence
  "Variant of ADP-beta-1,3-glucosyltransferase"
MPNTSPTTGRRRRVILFPVPFPGHLNPMLQLANVLYSRGFAITILHTNFNAPKTSLYPHFSFRFILDNDPQTEWLRNLPTHGPGAGMRIPQINKHGADEFRKELESAMRDSPDDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVTLENGFERGEIVNAIRRVMVDPEGEVMRQNARKLKDKLDRSIAPGGSSYESLERLVSYISSL

SEQ ID NO: 7963 - DNA, 1371 bp, Artificial Sequence
  "Variant of ADP-beta-1,3-glucosyltransferase"
atgccaaacacaagccccaccaccggtcgtcgtcgtcgtgttattctgtttccggttccgttcccgggccacttaaacccgatgctgcaactggcgaacgtgctgtaccgcagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtaagagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 7964 - protein, 457 aa, Artificial Sequence
  "Variant of ADP-beta-1,3-glucosyltransferase"
MPNTSPTTGRRRRVILFPVPFPGHLNPMLQLANVLYRRGFAITILHTNFNAPKTSLYPHFSFRFILDNDPQTEWLRNLPTHGPGAGKRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7965 - DNA, 1371 bp, Artificial Sequence
  "Variant of ADP-beta-1,3-glucosyltransferase"
atgccaaacacaagccccaccaccgttcgtcgtcgtcgtgttattctgtttccggttccgttcccgggccacttaaacccgatgctgcaactggcgaacgtgctgtacagcagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccggatgacgaggaagttgcgtgcctgattaccgatgcgctgtggtacttcgcgcaaccggtggcggacagcctgaatctgaaacgtctggttctgcaaaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgggaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgttacgctggagaatggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 7966 - protein, 457 aa, Artificial Sequence
  "Variant of ADP-beta-1,3-glucosyltransferase"
MPNTSPTTVRRRRVILFPVPFPGHLNPMLQLANVLYSRGFAITILHTNFNAPKTSLYPHFSFRFILDNDPQTEWLRNLPTHGPGAGMRIPQINKHGADEFRKELESAMRDSPDDEEVACLITDALWYFAQPVADSLNLKRLVLQTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVTLENGFERGEIVNAIRRVMVDPEGEVMRQNARKLKDKLDRSIAPGGSSYESLERLVSYISSL

SEQ ID NO: 7967 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccggcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtatattgaaggataagttggatcgaagccttgctcccggtggcagcagctacgagagcctggaacgcctggttagctatattagcagcctg

SEQ ID NO: 7968 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDRQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARILKDKLDRSLAPGGSSYESLERLVSYISSL

SEQ ID NO: 7969 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgcagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccggatgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgttcagaatgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 7970 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPDDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVQNEIPAPSFLLPLPKHYRASSSSLLDEDPSVAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7971 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgtcggacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgttcagcgggaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgttacgctggagcaaggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 7972 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVQREIPAPSFLLPLPKHYRASSSSLLDEDPSVAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVTLEQGFERGEIVNAIRRVMVDPEGEVMRQNARKLKDKLDRSIAPGGSSYESLERLVSYISSL

SEQ ID NO: 7973 - DNA, 1371 bp, Artificial Sequence
  "Variant of ADP-beta-1,3-glucosyltransferase"
atgccaaacacaagccccaccaccgttcgtcgtcgtcgtgttattctgtttccggttccgttcccgggccacttaaacccgatgctgcaactggcgaacgtgctgtaccgtagaggttttgcgatcaccattctgcacaccaacttcaacgccccggaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggaatgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 7974 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPETSLYPHFSFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWNEIPAPSFLLPLPKHYRASSSSLLDEDPSVAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7975 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgcagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgcaaaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggaatgaaattccggcgccgagcttcctgcttccgctgccgaagcattatagggcgagcagcagcagcctgctggatgaagatccgagcgtggcccaatggctggaccggcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttacctggagaatggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 7976 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACLITDALWYFAQPVADSLNLKRLVLQTSSLFNFHALVCLPQFLELGYLDPEDKHRPEEPVVGFPMLKVKDIRRAYSHWQEAKPILDKMIEETRASSGVIWNSFKELEESELETVWNEIPAPSFLLPLPKHYRASSSSLLDEDPSVAQWLDRQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7977 - DNA, 1371 bp, Artificial Sequence
  "Variant of ADP-beta-1,3-glucosyltransferase"
atgccgaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggaaagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttgccgagctggaggaaagcgagctggaaaccgtttggcgtgaaattccggcgccgagcttcctgcttccgctgccgaagcattatagggcgagcagcagcagcctgctggatgaagatccgagcactgcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagttactgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 7978 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACLITDALWYFAQPVAESLNLKRLVLMTSSLFNFHALVCLPQFLELGYLDPEDKHRPEEPVVGFPMLKVKDIRRAYSHWQEAKPILDKMIEETRASSGVIWNSFAELEESELETVWREIPAPSFLLPLPKHYRASSSSLLDEDPSTAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7979 - DNA, 1371 bp, Artificial Sequence
  "Variant of ADP-beta-1,3-glucosyltransferase"
atgccgaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaggagctggaggaaagcgagctggaaaccgtttggcgtgaaattccggcgccgagcttcctgcttccgctgccgaagcattatagggcgagcagcagcagcctgctggatgaagatccgagcactgcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagttactgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 7980 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7981 - DNA, 1371 bp, Artificial Sequence
  "Variant of ADP-beta-1,3-glucosyltransferase"
atgccgaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgctccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggaaagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 7982 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNAPQTEWLRNLPTHGPGAGMRIPQINKHGADEFRKELESAMRDSPSDEEVACLITDALWYFAQPVAESLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7983 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgctccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaggagctggaggaaagcgagctggaaaccgtttggcgtgaaattccggcgccgagcttcctgcttccgctgccgaagcattatagggcgagcagcagcagcctgctggatgaagatccgagcactgcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagttactgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgacttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggaaagaagcattagtcatggtggctctagctacgagagcctggaacgcctggttagctatattagcagcctg

SEQ ID NO: 7984 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNAPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLERSISHGGSSYESLERLVSYISSL

SEQ ID NO: 7985 - DNA, 1371 bp, Artificial Sequence
  "Variant of ADP-beta-1,3-glucosyltransferase"
atgccgaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagatccgcatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaggagctggaggaaagcgagctggaaaccgtttggcgtgaaattccggcgccgagcttcctgcttccgctgccgaagcattatagggcgagcagcagcagcctgctggatgaagatccgagcactgcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 7986 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDPHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7987 - DNA, 1371 bp, Artificial Sequence
  "Variant of ADP-beta-1,3-glucosyltransferase"
atgccgaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccaggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaggagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagtcactgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 7988 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKQSFLWRVRPGFVKGYEWIESLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7989 - DNA, 1371 bp, Artificial Sequence
  "Variant of ADP-beta-1,3-glucosyltransferase"
atgccgaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgctccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcactgcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 7990 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNAPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSTAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7991 - DNA, 1371 bp, Artificial Sequence
  "Variant of ADP-beta-1,3-glucosyltransferase"
atgccgaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgaccactggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgacttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 7992 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTTGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7993 - DNA, 1371 bp, Artificial Sequence
  "Variant of ADP-beta-1,3-glucosyltransferase"
atgccgaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgttatttggaacagctttgccgagctggaggaaagcgagctggaaaccgtttggcgtgaaattccggcgccgagcttcctgcttccgctgccgaagcattatagggcgagcagcagcagcctgctggatgaagatccgagcactgcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgacttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatataagcattgcccctggtggctttagctacgagagcctggaacgcctggttagctatattagcagcctg

SEQ ID NO: 7994 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFAELEESELETVWREIPAPSFLLPLPKHYRASSSSLLDEDPSTAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDISIAPGGFSYESLERLVSYISSL

SEQ ID NO: 7995 - DNA, 1371 bp, Artificial Sequence
  "Variant of ADP-beta-1,3-glucosyltransferase"
atgccgaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgaccactggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggatagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttgccgagctggaggaaagcgagctggaaaccgtttggcgtgaaattccggcgccgagcttcctgcttccgctgccgaagcattatagggcgagcagcagcagcctgctggatgaagatccgagcactgcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagtcactgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatgaaagcattgcccctggtggctttagctacgagagcctggaacgcctggttagctatattagcagcctg

SEQ ID NO: 7996 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTTGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFAELEESELETVWREIPAPSFLLPLPKHYRASSSSLLDEDPSTAQWLDQQPPSSVLYVGFGSQSEVDPKDFLEIARGLVDSKQSFLWRVRPGFVKGYEWIESLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDESIAPGGFSYESLERLVSYISSL

SEQ ID NO: 7997 - DNA, 1371 bp, Artificial Sequence
  "Variant of ADP-beta-1,3-glucosyltransferase"
atgccgaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgaccactggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggaaagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgacttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 7998 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTTGPGAGMRIPQINKHGADEFRKELESAMRDSPSDEEVACLITDALWYFAQPVAESLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 7999 - DNA, 1371 bp, Artificial Sequence
  "Variant of ADP-beta-1,3-glucosyltransferase"
atgccgaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgaccactggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggatagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtagcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagttactgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataaggcagatatcagcattaggcctggtggctttagctacgagagcctggaacgcctggttagctatattagcagcctg

SEQ ID NO: 8000 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTTGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKADISIRPGGFSYESLERLVSYISSL

SEQ ID NO: 8001 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgctccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8002 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNAPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 8003 - DNA, 1371 bp, Artificial Sequence
  "Variant of ADP-beta-1,3-glucosyltransferase"
atgaaaatgacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaggagctggaggaaagcgagctggaaaccgtttggcgtgaaattccggcgccgagcttcctgcttccgctgccgaagcattatagggcgagcagcagcagcctgctggatgaagatccgagcgtagcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataaggcagatgaaagcattgcccctggtggctttagctacgagagcctggaacgcctggttagctatattagcagcctg

SEQ ID NO: 8004 - protein, 457 aa, Artificial Sequence
  "Variant of ADP-beta-1,3-glucosyltransferase"
MKMTSPTTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKADESIAPGGFSYESLERLVSYISSL

SEQ ID NO: 8005 - DNA, 1371 bp, Artificial Sequence
  "Variant of ADP-beta-1,3-glucosyltransferase"
atgccgaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgctccgcagaccgagtggcttcgcaacctgccgaccactggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgacttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8006 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNAPQTEWLRNLPTTGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 8007 - DNA, 1371 bp, Artificial Sequence
  "Variant of ADP-beta-1,3-glucosyltransferase"
atgccgaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgaccactggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttgccgagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagttactgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgacttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8008 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTTGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFAELEESELETVWREIPAPSFLLPLPKHYRASSSSLLDEDPSVAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 8009 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggatagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttgccgagctggaggaaagcgagctggaaaccgtttggcgtgaaattccggcgccgagcttcctgcttccgctgccaaagcattatagggcgagcagcagcagcctgctggatgaagatccgagcgtagcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagttactgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgacttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8010 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFAELEESELETVWREIPAPSFLLPLPKHYRASSSSLLDEDPSVAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 8011 - DNA, 1371 bp, Artificial Sequence
  "Variant of ADP-beta-1,3-glucosyltransferase"
atgaaaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgaccactggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8012 - protein, 457 aa, Artificial Sequence
  "Variant of ADP-beta-1,3-glucosyltransferase"
MKNTSPTTVRRRRVILFPVPFPGHLNPMLQLANVLYRRGFAITILHTNFNAPKTSLYPHFSFRFILDNDPQTEWLRNLPTTGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 8013 - DNA, 1371 bp, Artificial Sequence
  "Variant of ADP-beta-1,3-glucosyltransferase"
atgccgaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgctccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtagcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgcccatggtggctctagctacgagagcctggaacgcctggttagctatattagcagcctg

SEQ ID NO: 8014 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNAPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAHGGSSYESLERLVSYISSL

SEQ ID NO: 8015 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgattccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtttgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattacgcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8016 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLIPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAITRVMVDPEGEVMRQNARKLKDKLDRSIAPGGSSYESLERLVSYISSL

SEQ ID NO: 8017 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgagcctgccgcaatttttagagttgggccttctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagtggtatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaagtaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8018 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACLITDALWYFAQPVADSLNLKRLVLMTSSLFNFHALVSLPQFLELGLLDPEDKHRPEEPVVGFPMLKVKDIRRAYSHWQEAKPILDKMIEETRASSGVIWNSFKELEESELETVWREIPAPSFLLPLPKWYRASSSSLLDEDPSVAQWLDQQPPSSVLYVGFGSQSEVDPKDFLEIARGLVASKVSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 8019 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgagcctgccgaaatttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagtggtatagggcgagctcgagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtttgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8020 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACVITDALWYFAQPVADSLNLKRLVLMTSSLFNFHALVSLPKFLELGYLDPEDKHRPEEPVVGFPMLKVKDIRRAYSHWQEAKPILDKMIEETRASSGVIWNSFKELEESELETVWREIPAPSFLLPLPKWYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 8021 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggaaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccatttgcgaaggcgtgccgatgatctttagcgatttcggtctggatcagccgctgaacgcgcgttacatgagcgaagttctgcatgtgggcgtttatctggagaacggcttcgagcgtggtgagatcgttaacgcgattacgcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8022 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWKEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAICEGVPMIFSDFGLDQPLNARYMSEVLHVGVYLENGFERGEIVNAITRVMVDPEGEVMRQNARKLKDKLDRSIAPGGSSYESLERLVSYISSL

SEQ ID NO: 8023 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcacgagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaagtaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtttgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8024 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACVITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASTSSLLDEDPSVAQWLDQQPPSSVLYVGFGSQSEVDPKDFLEIARGLVASKVSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8025 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgagcctgccgaaatttttagaggcaggccttctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgattccgctgccgaagtggtatagggcgagcacgagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaagtaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8026 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGMRIPQINKHGADEFRKELESAMRDSPSDEEVACLITDALWYFAQPVADSLNLKRLVLMTSSLFNFHALVSLPKFLEAGLLDPEDKHRPEEPVVGFPMLKVKDIRRAYSHWQEAKPILDKMIEETRASSGVIWNSFKELEESELETVWREIPAPSFLIPLPKWYRASTSSLLDEDPSVAQWLDQQPPSSVLYVGFGSQSEVDPKDFLEIARGLVASKVSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 8027 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttctcatttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgatagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8028 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 8029 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgtgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgagcctgccgaaatttttagagttgggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgattccgctgccgaagtggtatagggcgagcacgagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgatagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtttgcgaaggcgtgccgatgatctttagcgatttcggtctggatcagccgctgaacgcgcgttacatgagcgaagttctgcatgtgggcgtttatctggagaacggcttcgagcgtggtcccatcattaacgcgattacgcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8030 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTHGPGVGMRIPQINKHGADEFRKELESAMRDSPSDEEVACLITDALWYFAQPVADSLNLKRLVLMTSSLFNFHALVSLPKFLELGYLDPEDKHRPEEPVVGFPMLKVKDIRRAYSHWQEAKPILDKMIEETRASSGVIWNSFKELEESELETVWREIPAPSFLIPLPKWYRASTSSLLDEDPSVAQWLDQQPPSSVLYVGFGSQSEVDPKDFLEIARGLVDSKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGPIINAITRVMVDPEGEVMRQNARKLKDKLDRSIAPGGSSYESLERLVSYISSL

SEQ ID NO: 8031 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgagcctgccgcaatttttagaggcaggccttctggatccggaagataaacatcgtccggaggaaccggtggtaggtttcccgatgctgaaggttaaagatatccgtcgcgcgtatagccactggaaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgatagcaaagtaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtttgcgaaggcgtgccgatgatctttagcgatttcggtctggatcagccgctgaacgcgcgttacatgagcgaagttctgcatgtgggcgtttatctggagaacggcttcgagcgtggtgagatcgttaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8032 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGMRIPQINKHGADEFRKELESAMRDSPSDEEVACVITDALWYFAQPVADSLNLKRLVLMTSSLFNFHALVSLPQFLEAGLLDPEDKHRPEEPVVGFPMLKVKDIRRAYSHWKEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKVSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 8033 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgagcctgccgcaatttttagagcttggctacctggatccggaagataaacatcgtccggaggaaccggtggtaggtttcccgatgctgaaggttaaagatatccgtcgcgcgtatagccactggaaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcgaaagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgatagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8034 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGMRIPQINKHGADEFRKELESAMRDSPSDEEVACLITDALWYFAQPVADSLNLKRLVLMTSSLFNFHALVSLPQFLELGYLDPEDKHRPEEPVVGFPMLKVKDIRRAYSHWKEAKPILDKMIEETRASSGVIWNSFKELEESELETVWREIPAPSFLLPLPKHYRASESSLLDEDPSVAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 8035 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggaaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtttgcgaaggcgtgccgatgatctttagcgatttcggtctggatcagccgctgaacgcgcgttacatgagcgaagttctgcatgtgggcgtttatctggagaacggcttcgagcgtggtgagatcgttaacgcgattacgcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8036 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWKEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAITRVMVDPEGEVMRQNARKLKDKLDRSIAPGGSSYESLERLVSYISSL

SEQ ID NO: 8037 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttctcatttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgaaatttttagaggcaggccttctggatccggaagataaacatcgtccggaggaaccggtggtaggtttcccgatgctgaaggttaaagatatccgtcgcgcgtatagccactggaaagaagctaaaccaattctggataagatgattgaagaaacccgtgccagccgcggtgtgatttggaacagctttaaagagctggaggaaagcgagctggaaaccgtttggcgtgaaattccggcgccgagcttcctgattccgctgccgaagcattatagggcgagctcgagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaagtaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtttgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8038 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACLITDALWYFAQPVADSLNLKRLVLMTSSLFNFHALVCLPKFLEAGLLDPEDKHRPEEPVVGFPMLKVKDIRRAYSHWKEAKPILDKMIEETRASRGVIWNSFKELEESELETVWREIPAPSFLIPLPKHYRASSSSLLDEDPSVAQWLDQQPPSSVLYVGFGSQSEVDPKDFLEIARGLVASKVSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8039 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttctcatttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgagcctgccgcaatttttagagttgggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagccgcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgatagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcgttaacgcgattacgcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8040 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACLITDALWYFAQPVADSLNLKRLVLMTSSLFNFHALVSLPQFLELGYLDPEDKHRPEEPVVGFPMLKVKDIRRAYSHWQEAKPILDKMIEETRASRGVIWNSFKELEESELETVWREIPAPSFLLPLPKHYRASSSSLLDEDPSVAQWLDQQPPSSVLYVGFGSQSEVDPKDFLEIARGLVDSKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAITRVMVDPEGEVMRQNARKLKDKLDRSIAPGGSSYESLERLVSYISSL

SEQ ID NO: 8041 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagccgcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcgttaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8042 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASRGVIWNSFKELEESELETVWREIPAPSFLLPLPKHYRASSSSLLDEDPSVAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 8043 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggaaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtttgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattacgcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8044 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWKEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAITRVMVDPEGEVMRQNARKLKDKLDRSIAPGGSSYESLERLVSYISSL

SEQ ID NO: 8045 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgagcctgccgcaatttttagaggcaggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgattccgctgccgaagtggtatagggcgagctcgagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaagtaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8046 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGMRIPQINKHGADEFRKELESAMRDSPSDEEVACLITDALWYFAQPVADSLNLKRLVLMTSSLFNFHALVSLPQFLEAGYLDPEDKHRPEEPVVGFPMLKVKDIRRAYSHWQEAKPILDKMIEETRASSGVIWNSFKELEESELETVWREIPAPSFLIPLPKWYRASSSSLLDEDPSVAQWLDQQPPSSVLYVGFGSQSEVDPKDFLEIARGLVASKVSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8047 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgagcctgccgcaatttttagaggcaggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccatttgcgaaggcgtgccgatgatctttagcgatttcggtctggatcagccgctgaacgcgcgttacatgagcgaagttctgcatgtgggcgtttatctggagaacggcttcgagcgtggtgagatcgttaacgcgattacgcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8048 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGMRIPQINKHGADEFRKELESAMRDSPSDEEVACLITDALWYFAQPVADSLNLKRLVLMTSSLFNFHALVSLPQFLEAGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVASKQSFLWRVRPGFVKGYEWIELLPDGFLGEKGRIVKSCPQQEVLAHKAIGAFWTHGGWNGTMEAICEGVPMIFSDFGLDQPLNARYMSEVLHVGVYLENGFERGEIVNAITRVMVDPEGEVMRQNARKLKDKLDRSIAPGGSSYESLERLVSYISSL

SEQ ID NO: 8049 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgagcctgccgaaatttttagagttgggctacctggatccggacgataaacatcgtccggaggaaccggtggtaggtttcccgatgctgaaggttaaagatatccgtcgcgcgtatagccactggaaagaagctaaaccaattctggataagatgattgaagaaacccgtgccagccgcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgatagcaaagtaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccatttgcgaaggcgtgccgatgatctttagcgatttcggtctggatcagccgctgaacgcgcgttacatgagcgaagttctgcatgtgggcgtttatctggagaacggcttcgagcgtggtcccatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8050 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACVITDALWYFAQPVADSLNLKRLVLMTSSLFNFHALVSLPKFLELGYLDPDDKHRPEEPVVGFPMLKVKDIRRAYSHWKEAKPILDKMIEETRASRGVIWNSFKELEESELETVWREIPAPSFLLPLPKHYRASSSSLLDEDPSVAQWLDQQPPSSVLYVGFGSQSEVDPKDFLEIARGLVDSKVSFLWLVRPGFVKGYEWIELLPDGFLGEKGRIVKSCPQQEVLAHKAIGAFWTHGGWNGTMEAICEGVPMIFSDFGLDQPLNARYMSEVLHVGVYLENGFERGPIINAIRRVMVDPEGEVMRQNARKLKDKLDRSIAPGGSSYESLERLVSYISSL

SEQ ID NO: 8051 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttctcatttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattacgcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8052 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACVITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAITRVMVDPEGEVMRQNARKLKDKLDRSIAPGGSSYESLERLVSYISSL

SEQ ID NO: 8053 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgagcctgccgcaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagtggtatagggcgagcacgagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8054 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACLITDALWYFAQPVADSLNLKRLVLMTSSLFNFHALVSLPQFLELGYLDPEDKHRPEEPVVGFPMLKVKDIRRAYSHWQEAKPILDKMIEETRASSGVIWNSFKELEESELETVWREIPAPSFLLPLPKWYRASTSSLLDEDPSVAQWLDQQPPSSVLYVGFGSQSEVDPKDFLEIARGLVDSKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 8055 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgagcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagtggtatagggcgagctcgagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgatagcaaagtaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtttgcgaaggcgtgccgatgatctttagcgatttcggtctggatcagccgctgaacgcgcgttacatgagcgaagttctgcatgtgggcgtttatctggagaacggcttcgagcgtggtgagatcgttaacgcgattacgcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8056 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACVITDALWYFAQPVADSLNLKRLVLMTSSLFNFHALVSLPQFLELGYLDPEDKHRPEEPVVGFPMLKVKDIRRAYSHWQEAKPILDKMIEETRASSGVIWNSFKELEESELETVWREIPAPSFLLPLPKWYRASSSSLLDEDPSVAQWLDQQPPSSVLYVGFGSQSEVDPKDFLEIARGLVDSKVSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAITRVMVDPEGEVMRQNARKLKDKLDRSIAPGGSSYESLERLVSYISSL

SEQ ID NO: 8057 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttctcatttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggaaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcacgagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgatagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8058 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWKEAKPILDKMIEETRASSGVIWNSFKELEESELETVWREIPAPSFLLPLPKHYRASTSSLLDEDPSVAQWLDQQPPSSVLYVGFGSQSEVDPKDFLEIARGLVDSKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8059 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaagtaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8060 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGMRIPQINKHGADEFRKELESAMRDSPSDEEVACVITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVASKVSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8061 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggccttctggatccggaagataaacatcgtccggaggaaccggtggtaggtttcccgatgctgaaggttaaagatatccgtcgcgcgtatagccactggaaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgatagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8062 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACVITDALWYFAQPVADSLNLKRLVLMTSSLFNFHALVCLPKFLELGLLDPEDKHRPEEPVVGFPMLKVKDIRRAYSHWKEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 8063 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccatttgcgaaggcgtgccgatgatctttagcgatttcggtctggatcagccgctgaacgcgcgttacatgagcgaagttctgcatgtgggcgtttatctggagaacggcttcgagcgtggtcccatcgttaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8064 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAICEGVPMIFSDFGLDQPLNARYMSEVLHVGVYLENGFERGPIVNAIRRVMVDPEGEVMRQNARKLKDKLDRSIAPGGSSYESLERLVSYISSL

SEQ ID NO: 8065 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggaaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcacgagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcgttaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8066 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACVITDALWYFAQPVADSLNLKRLVLMTSSLFNFHALVCLPQFLELGYLDPEDKHRPEEPVVGFPMLKVKDIRRAYSHWKEAKPILDKMIEETRASSGVIWNSFKELEESELETVWREIPAPSFLLPLPKHYRASTSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 8067 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagccgcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8068 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASRGVIWNSFKELEESELETVWREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 8069 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttctcatttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagaggcaggctacctggatccggaagataaacatcgtccggaggaaccggtggtaggtttcccgatgctgaaggttaaagatatccgtcgcgcgtatagccactggaaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcgaaagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaagtaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccatttgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8070 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLEAGYLDPEDKHRPEEPVVGFPMLKVKDIRRAYSHWKEAKPILDKMIEETRASSGVIWNSFKELEESELETVWREIPAPSFLLPLPKHYRASESSLLDEDPSVAQWLDQQPPSSVLYVGFGSQSEVDPKDFLEIARGLVASKVSFLWLVRPGFVKGYEWIELLPDGFLGEKGRIVKSCPQQEVLAHKAIGAFWTHGGWNGTMEAICEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 8071 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttctcatttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgatagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8072 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 8073 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagaggcaggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaagtaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtttgcgaaggcgtgccgatgatctttagcgatttcggtctggatcagccgctgaacgcgcgttacatgagcgaagttctgcatgtgggcgtttatctggagaacggcttcgagcgtggtcccatcattaacgcgattacgcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8074 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLEAGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVASKVSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGPIINAITRVMVDPEGEVMRQNARKLKDKLDRSIAPGGSSYESLERLVSYISSL

SEQ ID NO: 8075 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcaatttttagagttgggccttctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagtggtatagggcgagcacgagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtttgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattacgcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8076 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLELGLLDPEDKHRPEEPVVGFPMLKVKDIRRAYSHWQEAKPILDKMIEETRASSGVIWNSFKELEESELETVWREIPAPSFLLPLPKWYRASTSSLLDEDPSVAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAITRVMVDPEGEVMRQNARKLKDKLDRSIAPGGSSYESLERLVSYISSL

SEQ ID NO: 8077 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaagtaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtttgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8078 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVASKVSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 8079 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttctcatttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgagcctgccgcaatttttagagttgggctacctggatccggaagataaacatcgtccggaggaaccggtggtaggtttcccgatgctgaaggttaaagatatccgtcgcgcgtatagccactggaaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagtggtatagggcgagctcgagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtttgcgaaggcgtgccgatgatctttagcgatttcggtctggatcagccgctgaacgcgcgttacatgagcgaagttctgcatgtgggcgtttatctggagaacggcttcgagcgtggtgagatcgttaacgcgattacgcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8080 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACLITDALWYFAQPVADSLNLKRLVLMTSSLFNFHALVSLPQFLELGYLDPEDKHRPEEPVVGFPMLKVKDIRRAYSHWKEAKPILDKMIEETRASSGVIWNSFKELEESELETVWREIPAPSFLLPLPKWYRASSSSLLDEDPSVAQWLDQQPPSSVLYVGFGSQSEVDPKDFLEIARGLVASKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAITRVMVDPEGEVMRQNARKLKDKLDRSIAPGGSSYESLERLVSYISSL

SEQ ID NO: 8081 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaagtaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8082 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVASKVSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 8083 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttctcatttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcaatttttagagttgggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtcccatcgttaacgcgattacgcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8084 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGPIVNAITRVMVDPEGEVMRQNARKLKDKLDRSIAPGGSSYESLERLVSYISSL

SEQ ID NO: 8085 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggaaagaagcaaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaagtaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccatttgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8086 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWKEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVASKVSFLWLVRPGFVKGYEWIELLPDGFLGEKGRIVKSCPQQEVLAHKAIGAFWTHGGWNGTMEAICEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 8087 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcgtgattaccgatgcgctgtggtacttcgcgcaaccggtggcggacagcctgaatctgaaacgtctggttctgatgaccagcagcctgtttaacttccacgcgctggtgtgcctgccgaaatttttagagttgggctacctggatccggaagataaacatcgtccggaggaaccggtggtaggtttcccgatgctgaaggttaaagatatccgtcgcgcgtatagccactggcaagaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaacaaagctttctgtggctggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgagatcattaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8088 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGMRIPQINKHGADEFRKELESAMRDSPSDEEVACVITDALWYFAQPVADSLNLKRLVLMTSSLFNFHALVCLPKFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVASKQSFLWLVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIINAIRRVMVDPEGEVMRQNARKLKDKLDRSIAPGGSSYESLERLVSYISSL

SEQ ID NO: 8089 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttccagtttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgctagcaaagtaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtcccatcgttaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8090 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFQFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVASKVSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGPIVNAIRRVMVDPEGEVMRQNARKLKDKLDRSIAPGGSSYESLERLVSYISSL

SEQ ID NO: 8091 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattcagctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8092 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAIQLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8093 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaactgtgcggcggaagaactgatacagctgtgtcgcaaccgcaacgcctacaag

SEQ ID NO: 8094 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNCAAEELIQLCRNRNAYK

SEQ ID NO: 8095 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaataccgtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8096 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYRNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8097 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttacagagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8098 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLQSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8099 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttattgagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8100 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLLSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8101 - DNA, 1350 bp, Artificial Sequence
  "Variant of ADP-beta-1,3-glucosyltransferase"
atgcaccatcatcatgaaggcgtgagcggcctgaccctgagagtactgatgtttccgtggcttgcgctgggtcatgttaacccgtttttgcgtatcgctaaacaactggccgatcgtggttttgttatccatctcgttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8102 - protein, 450 aa, Artificial Sequence
  "Variant of ADP-beta-1,3-glucosyltransferase"
MHHHHEGVSGLTLRVLMFPWLALGHVNPFLRIAKQLADRGFVIHLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8103 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttatgtagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8104 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLCSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8105 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttaactagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8106 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLTSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8107 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccaagattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8108 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTKINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8109 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccgacgctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccacctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8110 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPTLVLYDFLQPWAEKVALEQGIPAVPVLTSGAALFSYFFNFLKRPGHEFPFPAIHLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8111 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttaatgaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8112 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLNELGVAVEIVRDEDGRIHRGEIAQVLKDVISGPTGEILRAKVRDISKRLRARREEEMNAAAEELIQLCRNRNAYK

SEQ ID NO: 8113 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactagggagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8114 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTREILRAKVRDISKRLRARREEEMNAAAEELIQLCRNRNAYK

SEQ ID NO: 8115 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactacgaacggtttaccaccgcatctgaacgggaccctgcacaaggcactgaagatgagcgctcccaactttagcaagatccttcaaaacctgaagccggacctggtcctttacgattttctgcaaccgtggtctgaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8116 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWSEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8117 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccaatattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattggcggcgcgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8118 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTNINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVIGGATGEILRAKVRDISKRLRARREEEMNAAAEELIQLCRNRNAYK

SEQ ID NO: 8119 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattcggcaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8120 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIRQVLKDVISGPTGEILRAKVRDISKRLRARREEEMNAAAEELIQLCRNRNAYK

SEQ ID NO: 8121 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcacggttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8122 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFTVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8123 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgactttagcaaacgcctgagagcgagacgcgaggaggaaatgaacgcagcggcggaagaactgatacagctgtgtcgcaaccgcaacgcctacaag

SEQ ID NO: 8124 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDFSKRLRARREEEMNAAAEELIQLCRNRNAYK

SEQ ID NO: 8125 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaacagatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8126 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREQMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8127 - DNA, 1350 bp, Artificial Sequence
  "Variant of ADP-beta-1,3-glucosyltransferase"
atgcaccatcatcatgaaggcgtgagcggcctgaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttcctctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8128 - protein, 450 aa, Artificial Sequence
  "Variant of ADP-beta-1,3-glucosyltransferase"
MHHHHEGVSGLTLRVLMFPWLALGHVNPFLRIAKQLADRGFVIYLVSTAINLESIKKRIPEKYSNSIHLVPLALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8129 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtgtgtgtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8130 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVCVEIVRDEDGRIHRGEIAQVLKDVISGPTGEILRAKVRDISKRLRARREEEMNAAAEELIQLCRNRNAYK

SEQ ID NO: 8131 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagtcggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8132 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKSDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8133 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaaactatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8134 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSRETMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8135 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacggtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8136 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYGNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8137 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattcatcaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcatacaag

SEQ ID NO: 8138 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIHQVLKDVISGPTGEILRAKVRDISKRLRARREEEMNAAAEELIQLCRNRNAYK

SEQ ID NO: 8139 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaacatgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8140 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKHALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8141 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccgggtctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8142 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPGLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8143 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaaggcggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8144 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKADLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8145 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccggtattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8146 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTGINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8147 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacagggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8148 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHRALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8149 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgtcgggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8150 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTSGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8151 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcgagttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8152 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFEFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8153 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtactgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8154 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSTVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8155 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagctggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8156 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKLDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8157 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccgcaggttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8158 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPQVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8159 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacagattaagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8160 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQIKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8161 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttacgtatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8162 - protein, 450 aa, Artificial Sequence
  "Variant of ADP-beta-1,3-glucosyltransferase"
MHHHHEGVSGQTLRVLMFPWLALGHVNPFLRIAKQLADRGFVTYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8163 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctggaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattggcggcgcgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8164 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVIGGATGEILRAKVRDISKRLRARREEEMNAAAEELIQLCRNRNAYK

SEQ ID NO: 8165 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttgaggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8166 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFEAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8167 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatactgctgtgtcgcaaccgcaacgcctacaag

SEQ ID NO: 8168 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELILLCRNRNAYK

SEQ ID NO: 8169 - DNA, 1350 bp, Artificial Sequence
  "Variant of ADP-beta-1,3-glucosyltransferase"
atgcaccatcatcatgaaggcgtgagcggcctgaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaactctaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8170 - protein, 450 aa, Artificial Sequence
  "Variant of ADP-beta-1,3-glucosyltransferase"
MHHHHEGVSGLTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNSNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8171 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccggttttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccacctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8172 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPGFSKILQNLKPDLVLYDFLQPWAEKVALEQGIPAVPVLTSGAALFSYFFNFLKRPGHEFPFPAIHLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8173 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgctttcggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8174 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLSELGVAVEIVRDEDGRIHRGEIAQVLKDVISGPTGEILRAKVRDISKRLRARREEEMNAAAEELIQLCRNRNAYK

SEQ ID NO: 8175 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttctcggttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8176 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFSVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8177 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttactctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8178 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVTLALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8179 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaactggcccaagtcctgaaagatgtgattggcggcgcgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8180 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGELAQVLKDVIGGATGEILRAKVRDISKRLRARREEEMNAAAEELIQLCRNRNAYK

SEQ ID NO: 8181 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacctgagcaaacgcctgagagcgagacgcgaggaggaaatgaacgcagcggcggaagaactgatacagctgtgtcgcaaccgcaacgcctacaag

SEQ ID NO: 8182 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDLSKRLRARREEEMNAAAEELIQLCRNRNAYK

SEQ ID NO: 8183 - DNA, 1350 bp, Artificial Sequence
  "Variant of ADP-beta-1,3-glucosyltransferase"
atgcaccatcatcatgaaggcgtgagcggcctgaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttacgctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8184 - protein, 450 aa, Artificial Sequence
  "Variant of ADP-beta-1,3-glucosyltransferase"
MHHHHEGVSGLTLRVLMFPWLALGHVNPFLRIAKQLADRGFVIYLVSTAINLESIKKRIPEKYSNSIHLVTLALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8185 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattatgctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8186 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAIMLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8187 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccgagtctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8188 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPSLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8189 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattaagcaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8190 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIKQVLKDVISGPTGEILRAKVRDISKRLRARREEEMNAAAEELIQLCRNRNAYK

SEQ ID NO: 8191 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgagtcatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattggcggcgcgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8192 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILSHPSTGGFISHCGWNSVMESIDFGVPIIAMPMQWDQPINARLLVELGVAVEIVRDEDGRIHRGEIAQVLKDVIGGATGEILRAKVRDISKRLRARREEEMNAAAEELIQLCRNRNAYK

SEQ ID NO: 8193 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacttgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8194 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNLNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8195 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattctgcaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8196 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEILQVLKDVISGPTGEILRAKVRDISKRLRARREEEMNAAAEELIQLCRNRNAYK

SEQ ID NO: 8197 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcgggggaactgatacagctgtgtcgcaaccgcaacgcctacaag

SEQ ID NO: 8198 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAGELIQLCRNRNAYK

SEQ ID NO: 8199 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccacctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcatcgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacttgagcaaacgcctgagagcgagacgcgaggaggaaatgaacgcagcggcggaagaactgatacagctgtgtcgcaaccgcaacgcctacaag

SEQ ID NO: 8200 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIHLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDLSKRLRARREEEMNAAAEELIQLCRNRNAYK

SEQ ID NO: 8201 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccacctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggatgaactgatacagctgtgtcgcaaccgcaacgcctacaag

SEQ ID NO: 8202 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIHLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAADELIQLCRNRNAYK

SEQ ID NO: 8203 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgcgatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8204 - protein, 450 aa, Artificial Sequence
  "Variant of ADP-beta-1,3-glucosyltransferase"
MHHHHEGVSGQTLRVLMFPWLALGHVNPFLRIAKQLADRGFAIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8205 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgcgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8206 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNANFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8207 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccgggtgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8208 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPGVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8209 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttaataccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacttggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8210 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVNTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8211 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaaggctgacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgattggcggcgcgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8212 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKADLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVIGGATGEILRAKVRDISKRLRARREEEMNAAAEELIQLCRNRNAYK

SEQ ID NO: 8213 - DNA, 1350 bp, Artificial Sequence
  "Variant of ADP-beta-1,3-glucosyltransferase"
atgcaccatcatcatgaaggcgtgagcggcctgaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgataagtctgtgtcgcaaccgcaacgcctacaag

SEQ ID NO: 8214 - protein, 450 aa, Artificial Sequence
  "Variant of ADP-beta-1,3-glucosyltransferase"
MHHHHEGVSGLTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELISLCRNRNAYK

SEQ ID NO: 8215 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaaggttgacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8216 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKVDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8217 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacttgaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8218 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYLNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8219 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctaccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaatgtcgcgacattagcaaacgcctgagagcgagacgcgaggaggaaatgaacgcagcggcggaagaactgatacagctgtgtcgcaaccgcaacgcctacaag

SEQ ID NO: 8220 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKCRDISKRLRARREEEMNAAAEELIQLCRNRNAYK

SEQ ID NO: 8221 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatttggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8222 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDLEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8223 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttggtgaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8224 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLGELGVAVEIVRDEDGRIHRGEIAQVLKDVISGPTGEILRAKVRDISKRLRARREEEMNAAAEELIQLCRNRNAYK

SEQ ID NO: 8225 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggtggaactgatacagctgtgtcgcaaccgcaacgcctacaag

SEQ ID NO: 8226 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAVELIQLCRNRNAYK

SEQ ID NO: 8227 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgcgattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8228 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGAIAQVLKDVISGPTGEILRAKVRDISKRLRARREEEMNAAAEELIQLCRNRNAYK

SEQ ID NO: 8229 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccacatttaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8230 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPHLPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8231 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaacgtgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8232 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKRALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8233 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacggggtgctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8234 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGVLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8235 - DNA, 1350 bp, Artificial Sequence
  "Variant of ADP-beta-1,3-glucosyltransferase"
atgacgcatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8236 - protein, 450 aa, Artificial Sequence
  "Variant of ADP-beta-1,3-glucosyltransferase"
MTHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8237 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagactcttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8238 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKTLQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8239 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctacacaaggcactgaagatgagcgctcccaactttagcaagaatcttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8240 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKNLQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8241 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcactttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8242 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFTFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8243 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaacgtgagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8244 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNVSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8245 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacgcgaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8246 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYANSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8247 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaaccttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8248 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNLSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8249 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcacgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8250 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVTKDVISGPTGEILRAKVRDISKRLRARREEEMNAAAEELIQLCRNRNAYK

SEQ ID NO: 8251 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaaagtgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8252 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKSALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8253 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaactcgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8254 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNSNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8255 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggcgctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8256 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPALVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8257 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacaagaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8258 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNKNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8259 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagattgacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8260 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKIDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8261 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttctgtatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8262 - protein, 450 aa, Artificial Sequence
  "Variant of ADP-beta-1,3-glucosyltransferase"
MHHHHEGVSGQTLRVLMFPWLALGHVNPFLRIAKQLADRGFVLYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8263 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccacggcgaaattgcccaagtcctgaaagatgtgatttcgggcccgactggtgagatcctgcgcgcgaaagtacgcgactggagcaaacgcctgagagcgagacgcgaggaggaaatgaacgcagcggcggaagaactgatacagctgtgtcgcaaccgcaacgcctacaag

SEQ ID NO: 8264 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHHGEIAQVLKDVISGPTGEILRAKVRDWSKRLRARREEEMNAAAEELIQLCRNRNAYK

SEQ ID NO: 8265 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccacgtttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8266 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPTFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8267 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttcgtgaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8268 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLRELGVAVEIVRDEDGRIHRGEIAQVLKDVISGPTGEILRAKVRDISKRLRARREEEMNAAAEELIQLCRNRNAYK

SEQ ID NO: 8269 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgccgtttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8270 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVPFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8271 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagttctgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgtccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8272 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSSAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIVQVLKDVISGPTGEILRAKVRDISKRLRARREEEMNAAAEELIQLCRNRNAYK

SEQ ID NO: 8273 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaattttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgcgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8274 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIARDEDGRIHRGEIAQVLKDVISGPTGEILRAKVRDISKRLRARREEEMNAAAEELIQLCRNRNAYK

SEQ ID NO: 8275 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagcagcttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8276 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKQLQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8277 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagcatcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8278 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKHREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8279 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaattggcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8280 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKLALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8281 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtctctcttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8282 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVSLEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8283 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttctgtttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8284 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFCFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8285 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattgtgctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8286 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAIVLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8287 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgagccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattactcaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8288 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILSHPSTGGFISHCGWNSVMESIDFGVPIIAMPMQWDQPINARLLVELGVAVEIVRDEDGRIHRGEITQVLKDVISGPTGEILRAKVRDISKRLRARREEEMNAAAEELIQLCRNRNAYK

SEQ ID NO: 8289 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagactcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8290 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKTREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8291 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggctgctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8292 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGLLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8293 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcagtattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8294 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGSIAQVLKDVISGPTGEILRAKVRDISKRLRARREEEMNAAAEELIQLCRNRNAYK

SEQ ID NO: 8295 - DNA, 1350 bp, Artificial Sequence
  "Variant of ADP-beta-1,3-glucosyltransferase"
atgcaccattttcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8296 - protein, 450 aa, Artificial Sequence
  "Variant of ADP-beta-1,3-glucosyltransferase"
MHHFHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8297 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccgtctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8298 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPSVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8299 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaaggtgcttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8300 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKVLQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8301 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgatatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagtgcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8302 - protein, 450 aa, Artificial Sequence
  "Variant of ADP-beta-1,3-glucosyltransferase"
MHHHHEGVSGQTLRVLMFPWLALGHVNPFLRIAKQLADRGFDIYLVSTAINLESIKKRIPEKYSNSIHLVELALPELPELPPHYHTTNGLPPHLNGTLHKALKMSAPNFSKILQNLKPDLVLYDFLQPWAEKVALEQCIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8303 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacgttaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8304 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYVNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8305 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccactgttaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8306 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPLLPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8307 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaggccggacctggtcctttacgattttctgcaaccgtgggcagaaaaagtcgcccttgaacagggcatcccggctgttccggttctaaccagtggtgcggcactgtttagctactttttcactttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacggaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8308 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLRPDLVLYDFLQPWAEKVALEQGIPAVPVLTSGAALFSYFFTFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEERNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8309 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttatggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8310 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLMELGVAVEIVRDEDGRIHRGEIAQVLKDVISGPTGEILRAKVRDISKRLRARREEEMNAAAEELIQLCRNRNAYK

SEQ ID NO: 8311 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaataccagaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8312 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYQNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8313 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaaagtcgcgacattagcaaacgcctgagagcgagacgcgaggaggaaatgaacgcagcggcggaagaactaatacagctgtgtcgcaaccgcaacgcctacaag

SEQ ID NO: 8314 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKSRDISKRLRARREEEMNAAAEELIQLCRNRNAYK

SEQ ID NO: 8315 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgcgatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccgcctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8316 - protein, 450 aa, Artificial Sequence
  "Variant of ADP-beta-1,3-glucosyltransferase"
MHHHHEGVSGQTLRVLMFPWLALGHVNPFLRIAKQLADRGFAIYLVSTAINLESIKKRIPEKYSNSIHLVELALPELPELPPHYHTTNGLPPHLNGTLHKALKMSAPNFSKILQNLKPDLVLYDFLQPWAEKVALEQGIPPVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8317 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattatgcaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8318 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIMQVLKDVISGPTGEILRAKVRDISKRLRARREEEMNAAAEELIQLCRNRNAYK

SEQ ID NO: 8319 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactgggggatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8320 - protein, 450 aa, Artificial Sequence
  "Variant of ADP-beta-1,3-glucosyltransferase"
MHHHHEGVSGQTLRVLMFPWLALGHVNPFLRIAKQLGDRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8321 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagaggcttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8322 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKRLQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8323 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatgtatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8324 - protein, 450 aa, Artificial Sequence
  "Variant of ADP-beta-1,3-glucosyltransferase"
MHHHHEGVSGQTLRVLMFPWLALGHVNPFLRIAKQLADRGFVMYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8325 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactatagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8326 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNYSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8327 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcactccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8328 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGTPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8329 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacagaggaagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8330 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQRKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8331 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttgcgtatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8332 - protein, 450 aa, Artificial Sequence
  "Variant of ADP-beta-1,3-glucosyltransferase"
MHHHHEGVSGQTLRVLMFPWLALGHVNPFLRIAKQLADRGFVAYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8333 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtcagttcgttatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8334 - protein, 450 aa, Artificial Sequence
  "Variant of ADP-beta-1,3-glucosyltransferase"
MHHHHEGVSGQTLRVLMFPWLALGHVNPFLRIAKQLADRQFVIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8335 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgggatctatttagttagtaccgctattaacctcgaaagcatcaaaaagagaatcccggagaaatacagtaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8336 - protein, 450 aa, Artificial Sequence
  "Variant of ADP-beta-1,3-glucosyltransferase"
MHHHHEGVSGQTLRVLMFPWLALGHVNPFLRIAKQLADRGFGIYLVSTAINLESIKKRIPEKYSNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8337 - DNA, 1350 bp, Artificial Sequence
  "Variant of ADP-beta-1,3-glucosyltransferase"
atgcaccatcatcatgaaggcgtgagcggccagaccctgagagtactgatgtttccgtggcttgcgctgggtcatgttaacccgtttttgcgtatcgctaaacaactggccgatcgtggtttcgttatctatttagttagtaccgctattaacctcgaaagcatcaaaaagagaatcccggagaaatactttaatagcatccatctggttgagctggcgctgccagaattaccggaactgccaccacattaccatactaccaacggtttaccaccgcatctgaacgggaccctgcacaaggcactgaagatgagcgctcccaactttagcaagatccttcaaaacctgaagccggacctggtcctttacgattttctgcaaccgtgggcagaaaaagtcgcccttgaacagggcatcccggctgttccggttctaaccagtggtgcggcactgtttagctactttttcaacttcctgaagcgaccgggtcacgagtttccgtttccggcaatccgcctgtcgaagcgagaacaggataagatgcgcgagatgtttggaacagagccggatgaagaagatccgttagcacctggcaatgccggtatcatgctgatgtgcacgagccgcgtaattgaggctaagtacctggactattgcaccgaactgaccaatgtaaaagttgttccggttggtccgccatttcaggatccgatgaccgaagatatcgacgacaaagaactgattgattggttagataccaaacccgaaaacagtgttgtctatgtgtcgtttggcagcgaatacttcctgagccgtgaagatatggaagaagtcgcgttcggcctggagctgagcaacgtgaactttatctgggttgcacgctttccgaaaggcgaagaacagaatctggaagacgttctgccaaaaggcttcctggaacgcgttggtgatcgtggtcgcgttctggaccatctggtgccgcaggcccatattctgaaccatccgagcacgggtggcttcatctctcattgcggttggaacagcgtcatggaaagcattgatttcggcgttccgatcattgcgatgccgatgcagtgggatcagccgattaacgcgagactgcttgtggaattaggcgtggcagtggagatcgtgcgtgatgaagatggccggattcaccgcggcgaaattgcccaagtcctgaaagatgtgatttcgggcccgactggtgagatcctgcgcgcgaaagtacgcgacattagcaaacgcctgagagcgagacgcgaggaggaaatgaacgcagcggcggaagaactgatacagctgtgtcgcaaccgcaacgcctacaag

SEQ ID NO: 8338 - protein, 450 aa, Artificial Sequence
  "Variant of ADP-beta-1,3-glucosyltransferase"
MHHHHEGVSGQTLRVLMFPWLALGHVNPFLRIAKQLADRGFVIYLVSTAINLESIKKRIPEKYFNSIHLVELALPELPELPPHYHTTNGLPPHLNGTLHKALKMSAPNFSKILQNLKPDLVLYDFLQPWAEKVALEQGIPAVPVLTSGAALFSYFFNFLKRPGHEFPFPAIRLSKREQDKMREMFGTEPDEEDPLAPGNAGIMLMCTSRVIEAKYLDYCTELTNVKVVPVGPPFQDPMTEDIDDKELIDWLDTKPENSVVYVSFGSEYFLSREDMEEVAFGLELSNVNFIWVARFPKGEEQNLEDVLPKGFLERVGDRGRVLDHLVPQAHILNHPSTGGFISHCGWNSVMESIDFGVPIIAMPMQWDQPINARLLVELGVAVEIVRDEDGRIHRGEIAQVLKDVISGPTGEILRAKVRDISKRLRARREEEMNAAAEELIQLCRNRNAYK

SEQ ID NO: 8339 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggctttctaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8340 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLSNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 8341 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcctgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8342 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESLMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 8343 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtctgtgccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8344 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKQSFLWRVRPGFVKGYEWIELLPDGFLGEKGRIVKSVPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 8345 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagcctgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8346 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQPEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 8347 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcgattttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8348 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFDFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 8349 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcgattatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8350 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSDYPHFSFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 8351 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgtgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8352 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESVMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 8353 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcgagtttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8354 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFEFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 8355 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgatgatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8356 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTHGPGAGMMIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 8357 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgcttatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8358 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTHGPGAGMLIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 8359 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgagtctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8360 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACLITDALWYFAQPVADSLNLKRLVLMTSSLFNFHALVSLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 8361 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgagatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8362 - protein, 457 aa, Artificial Sequence
  "Variant of ADP-beta-1,3-glucosyltransferase"
MPNTSPTTVRRRRVILFPVPFPGHLNPMLQLANVLYRRGFEITILHTNFNAPKTSLYPHFSFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 8363 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaatcgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8364 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACLITDALWYFAQPVADSLNLNRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 8365 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtatgagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcacgaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8366 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTHGPGAGMRIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEITNAIRRVMVDPEGEVMRQNARKLKDKLDRSIAPGGSSYESLERLVSYISSL

SEQ ID NO: 8367 - DNA, 1371 bp, Artificial Sequence
  "Variant of ADP-beta-1,3-glucosyltransferase"
atgccaaacacaagccccaccaccgtgcgtcgtcgtcgtgttattctgtttccggttccgttcccgggccacttaaacccgatgctgcaactggcgaacgtgctgtaccgtagaggttttgcgatcaccattctgcacaccaacttcaacgccccgaaaaccagcctttatccgcacttcagctttcgttttatcttggacaacgatccgcagaccgagtggcttcgcaacctgccgacccatggtccgggcgcgggtgagagaatcccgcagattaacaagcacggcgcggatgaattccgtaaagagctggaaagcgcgatgcgggatagcccgagtgacgaggaagttgcgtgcctgattaccgatgcgctgtggtacttcgcgcaaccggtggcggacagcctgaatctgaaacgtctggttctgatgaccagcagcctgtttaacttccacgcgctggtgtgcctgccgcagtttttagagcttggctacctggatccggaagataaacatcgtccggaggaaccggtggtaggtttcccgatgctgaaggttaaagatatccgtcgcgcgtatagccactggcaggaagctaaaccaattctggataagatgattgaagaaacccgtgccagcagcggtgtgatttggaacagctttaaagagctggaggaaagcgagctggaaaccgtttggcgtgaaattccggcgccgagcttcctgcttccgctgccgaagcattatagggcgagcagcagcagcctgctggatgaagatccgagcgtggcccaatggctggaccagcaaccgccgagcagcgtgctgtacgttggctttggcagccagagcgaggtggaccccaaagatttcctggagattgcgcgtggtctggttgacagcaaacaaagctttctgtggcgggttcgtccgggcttcgtgaagggttatgagtggattgagctgctgccggatggttttctgggtgaaaaaggtcgtatcgtgaagtcttgcccgcaacaagaagtgctggcgcacaaggcgattggtgcgttctggacccacggcggttggaacggcaccatggaggccgtgtgcgaaggcgtgccgatgatctttagcgatttcggtctggatcagccgctgaacgcgcgttacatgagcgaagttctgcatgtgggcgtttatctggagaacggcttcgagcgtggtgaaatcgtaaacgcgattaggcgtgtgatggttgacccggaaggtgaggttatgcgtcaaaacgcgcgtaaattgaaggataagttggatcgaagcattgctcccggtggcagcagctacgagagcctggaacgcctggttagctatattagcagcctg

SEQ ID NO: 8368 - protein, 457 aa, Artificial Sequence
  "Variant of ADP-beta-1,3-glucosyltransferase"
MPNTSPTTVRRRRVILFPVPFPGHLNPMLQLANVLYRRGFAITILHTNFNAPKTSLYPHFSFRFILDNDPQTEWLRNLPTHGPGAGERIPQINKHGADEFRKELESAMRDSPSDEEVACLITDALWYFAQPVADSLNLKRLVLMTSSLFNFHALVCLPQFLELGYLDPEDKHRPEEPVVGFPMLKVKDIRRAYSHWQEAKPILDKMIEETRASSGVIWNSFKELEESELETVWREIPAPSFLLPLPKHYRASSSSLLDEDPSVAQWLDQQPPSSVLYVGFGSQSEVDPKDFLEIARGLVDSKQSFLWRVRPGFVKGYEWIELLPDGFLGEKGRIVKSCPQQEVLAHKAIGAFWTHGGWNGTMEAVCEGVPMIFSDFGLDQPLNARYMSEVLHVGVYLENGFERGEIVNAIRRVMVDPEGEVMRQNARKLKDKLDRSIAPGGSSYESLERLVSYISSL

SEQ ID NO: 8369 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaagattttcgcgcacagattccggaaggcccacccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagcccgcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagcggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgtcttccgattttggcgcttcgttctgtcacgcgaatcacaggtcatggaacgctatctgcaaatgttccgccacctgcaatggcgcccgctggctcatgccgtaccgatggag

SEQ ID NO: 8370 - protein, 793 aa, Artificial Sequence
  "Variant of ADP-beta-1,3-glucosyltransferase"
MIEELRQQLLDNPRSWRAFLRHLVASQRDSWLHTDLQRACKDFRAQIPEGPPEDIGWLADFVAHTQEAIFRDPWMVFAWRLRPGVWEYVRIHVEQLAVEELSTDEYLQAKEQLVGLGAEGEAVLTVDFEDFRPVSPRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQMRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFRFWRFVLSRESQVMERYLQMFRHLQWRPLAHAVPME

SEQ ID NO: 8371 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaagattttcgcgcacagcctccggaaggcccacccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagcccgcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagctgcggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgttgtttccagttttggcgcttcgttctgtcacgcgaatcacaggtcatggaacgctatctgcaaatgttccgccacctgcaatggcgcccgctggctcatgccgtaccgatggag

SEQ ID NO: 8372 - protein, 793 aa, Artificial Sequence
  "Variant of ADP-beta-1,3-glucosyltransferase"
MIEELRQQLLDNPRSWRAFLRHLVASQRDSWLHTDLQRACKDFRAQPPEGPPEDIGWLADFVAHTQEAIFRDPWMVFAWRLRPGVWEYVRIHVEQLAVEELSTDEYLQAKEQLVGLGAEGEAVLTVDFEDFRPVSPRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQMRWVGSQLDKTVAGELYRVVADGRGVFVQPALFEAFGLTVIEAMSCGLPVFATRHGGPLEIIEDGVSGFHIDPNDPEATAEKLADFLEAARERPHYWEEISDAALARVSERYTWERYAERLMTIARCFQFWRFVLSRESQVMERYLQMFRHLQWRPLAHAVPME

SEQ ID NO: 8373 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaagattttcgcgcacagcctccggaaggcccacccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagcggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgttgtttcggattttggcgcttcgttctgtcacgcgaatcacaggtcatggaacgctatctgcaaatgttccgccacctgcaatggcgcccgctggctcatgccgtaccgatggag

SEQ ID NO: 8374 - protein, 793 aa, Artificial Sequence
  "Variant of ADP-beta-1,3-glucosyltransferase"
MIEELRQQLLDSPRSWRAFLRHLVASQRDSWLHTDLQRACKDFRAQPPEGPPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQMRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARCFGFWRFVLSRESQVMERYLQMFRHLQWRPLAHAVPME

SEQ ID NO: 8375 - DNA, 2379 bp, Artificial Sequence
  "Variant of ADP-beta-1,3-glucosyltransferase"
atgattgaagaactgcgccaacagctgctggatgacccgcgttcatggcgtgcattcctgcgtcatttagtcgcatctcagcgtgactcatggttacatacggatttacagcgcgcgtgcaaagattttcgcgaacagcctccggaaggctaccccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagcccgcgtttaaaagacgagaacaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagcggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8376 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSPRLKDENTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 8377 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaagagacgagaacaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8378 - protein, 793 aa, Artificial Sequence
  "Variant of ADP-beta-1,3-glucosyltransferase"
MIEELRQQLLDNPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLRDENTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 8379 - DNA, 2379 bp, Artificial Sequence
  "Variant of ADP-beta-1,3-glucosyltransferase"
atgattgaagaactgcgccaacagctgctggatgtcccgcgttcatggcgtgcattcctgcgtcatttagtcgcatctcagcgtgactcatggttacatacggatttacagcgcgcgtgcaaagattttcgcgcacagattccggaaggctaccccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagaacaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagctgcggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgtcttccagttttggcgcttcgttctgtcacgcgaatcacaggtcatggaacgctatctgcaaatgttccgccacctgcaatggcgcccgctggctcatgccgtaccgatggag

SEQ ID NO: 8380 - protein, 793 aa, Artificial Sequence
  "Variant of ADP-beta-1,3-glucosyltransferase"
MIEELRQQLLDVPRSWRAFLRHLVASQRDSWLHTDLQRACKDFRAQIPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDENTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSCGLPVFATRHGGPLEIIEDGVSGFHIDPNDPEATAEKLADFLEAARERPHYWEEISDAALARVSERYTWERYAERLMTIARVFQFWRFVLSRESQVMERYLQMFRHLQWRPLAHAVPME

SEQ ID NO: 8381 - DNA, 2379 bp, Artificial Sequence
  "Variant of ADP-beta-1,3-glucosyltransferase"
atgattgaagaactgcgccaacagctgctggatgtcccgcgttcatggcgtgcattcctgcgtcatttagtcgcatctcagcgtgactcatggttacatacggatttacagcgcgcgtgcaaagattttcgcgcacagcttccggaaggctaccccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8382 - protein, 793 aa, Artificial Sequence
  "Variant of ADP-beta-1,3-glucosyltransferase"
MIEELRQQLLDVPRSWRAFLRHLVASQRDSWLHTDLQRACKDFRAQLPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 8383 - DNA, 2379 bp, Artificial Sequence
  "Variant of ADP-beta-1,3-glucosyltransferase"
atgattgaagaactgcgccaacagctgctggatgtcccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagaacaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagcggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgttgtttccagttttggcgcttcgttctgtcacgcgaatcacaggtcatggaacgctatctgcaaatgttccgccacctgcaatggcgcccgctggctcatgccgtaccgatggag

SEQ ID NO: 8384 - protein, 793 aa, Artificial Sequence
  "Variant of ADP-beta-1,3-glucosyltransferase"
MIEELRQQLLDVPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSQRLKDENTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARCFQFWRFVLSRESQVMERYLQMFRHLQWRPLAHAVPME

SEQ ID NO: 8385 - DNA, 2379 bp, Artificial Sequence
  "Variant of ADP-beta-1,3-glucosyltransferase"
atgattgaagaactgcgccaacagctgctggatagcccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagcggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgttgtttcggattttggcgcttcgttctgtcacgcgaatcacaggtcatggaacgctatctgcaaatgttccgccacctgcaatggcgcccgctggctcatgccgtaccgatggag

SEQ ID NO: 8386 - protein, 793 aa, Artificial Sequence
  "Variant of ADP-beta-1,3-glucosyltransferase"
MIEELRQQLLDSPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQMRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARCFGFWRFVLSRESQVMERYLQMFRHLQWRPLAHAVPME

SEQ ID NO: 8387 - DNA, 2379 bp, Artificial Sequence
  "Variant of ADP-beta-1,3-glucosyltransferase"
atgattgaagaactgcgccaacagctgctggataacccgcgttcatggcgtgcattcctgcgtcatttagtcgcatctcagcgtgactcatggttacatacggatttacagcgcgcgtgcaaagattttcgcgaacagcctgcggaaggcccacccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaaaagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgtcttccagttttggcgcttcgttctgtcacgcgaatcacaggtcatggaacgctatctgcaaatgttccgccacctgcaatggcgcccgctggctcatgccgtaccgatggag

SEQ ID NO: 8388 - protein, 793 aa, Artificial Sequence
  "Variant of ADP-beta-1,3-glucosyltransferase"
MIEELRQQLLDNPRSWRAFLRHLVASQRDSWLHTDLQRACKDFREQPAEGPPEDIGWLADFVAHTQEAIFRDPWMVFAWRLRPGVWEYVRIHVEQLAVEELSTDEYLQAKEQLVGLGAEGEAVLTVDFEDFRPVSQRLKDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFQFWRFVLSRESQVMERYLQMFRHLQWRPLAHAVPME

SEQ ID NO: 8389 - DNA, 2379 bp, Artificial Sequence
  "Variant of ADP-beta-1,3-glucosyltransferase"
atgattgaagaactgcgccaacagctgctggatgtcccgcgttcatggcgtgcattcctgcgtcatttagtcgcatctcagcgtgactcatggttacatacggatttacagcgcgcgtgcaaagattttcgcgcacagattgcggaaggctcccccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaagagacgagaacaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagatgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8390 - protein, 793 aa, Artificial Sequence
  "Variant of ADP-beta-1,3-glucosyltransferase"
MIEELRQQLLDVPRSWRAFLRHLVASQRDSWLHTDLQRACKDFRAQIAEGSPEDIGWLADFVAHTQEAIFRDPWMVFAWRLRPGVWEYVRIHVEQLAVEELSTDEYLQAKEQLVGLGAEGEAVLTVDFEDFRPVSQRLRDENTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQMRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 8391 - DNA, 2379 bp, Artificial Sequence
  "Variant of ADP-beta-1,3-glucosyltransferase"
atgattgaagaactgcgccaacagctgctggatgacccgcgttcatggcgtgcattcctgcgtcatttagtcgcatctcagcgtgactcatggttacatacggatttacagcgcgcgtgcaaagattttcgcgaacagattccggaaggctcccccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccagcgtttaagagacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgttgtttccagttttggcgcttcgttctgtcacgcgaatcacaggtcatggaacgctatctgcaaatgttccgccacctgcaatggcgcccgctggctcatgccgtaccgatggag

SEQ ID NO: 8392 - protein, 793 aa, Artificial Sequence
  "Variant of ADP-beta-1,3-glucosyltransferase"
MIEELRQQLLDDPRSWRAFLRHLVASQRDSWLHTDLQRACKDFREQIPEGSPEDIGWLADFVAHTQEAIFRDPWMVFAWRLRPGVWEYVRIHVEQLAVEELSTDEYLQAKEQLVGLGAEGEAVLTVDFEDFRPVSQRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARCFQFWRFVLSRESQVMERYLQMFRHLQWRPLAHAVPME

SEQ ID NO: 8393 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaggccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtatctgtggccagaaatcgaacgcctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggataggcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgagctattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8394 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQAVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADARTYFSYARTEERFSYLWPEIERLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVAGELYRVVADRRGVFVQPALFEAFGLTVIEAMSSGLPVFATRHGGPLEIIEDGVSGFHIDPNDPEATAEKLADFLEAARERPSYWEEISDAALARVSERYTWERYAERLMTIARVFGFWRFVLSRESQVMERYLQMFRHLQWRPLAHAVPME

SEQ ID NO: 8395 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtatctgtggccagaaatcgaaagcctgctgtttgggcgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8396 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADARTYFSYARTEERFSYLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 8397 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatacctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcggaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagccgggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagcctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcattattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8398 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRRTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREPGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 8399 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatacctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcgggccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccggttattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgggctattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8400 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRRAVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADARTYFSYARTEERFSSLWPEIESLLFGREPGPDIRGVLEDRQKPVILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPGYWEEISDAALARVSERYTWERYAERLMTIARVFGFWRFVLSRESQVMERYLQMFRHLQWRPLAHAVPME

SEQ ID NO: 8401 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcggaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtatctgtggccagaaatcgaaagcctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8402 - protein, 793 aa, Artificial Sequence
  "Variant of ADP-beta-1,3-glucosyltransferase"
MIEELRQQLLDDPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRRTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADARTYFSYARTEERFSYLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 8403 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatggctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaggccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaacgcctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggataggcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8404 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVEQLAVEELSTDEWLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQAVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADARTYFSYARTEERFSSLWPEIERLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVAGELYRVVADRRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 8405 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagcctgctgtttggccgcgaaccaggtccggatattcgtggtgttctcgaagatcgccagaaaccggttattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggataggcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcattattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8406 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPVILSMARMDRIKNLSGLAELYGRSSRLRSLANLVIIGGHVDVGNSMDAEEREEIRRMHEIMDHYQLDGQLRWVGSQLDKTVAGELYRVVADRRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 8407 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcggaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8408 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRRTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 8409 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatacctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcggaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtatctgtggccagaaatcgaaagtctgctgtttggccgcgaaccaggtccggatattcgtggtgttctcgaagatcgccagaaaccggttattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8410 - protein, 793 aa, Artificial Sequence
  "Variant of ADP-beta-1,3-glucosyltransferase"
MIEELRQQLLDDPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRRTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADARTYFSYARTEERFSYLWPEIESLLFGREPGPDIRGVLEDRQKPVILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 8411 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatacctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctgggtcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccggttattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8412 - protein, 793 aa, Artificial Sequence
  "Variant of ADP-beta-1,3-glucosyltransferase"
MIEELRQQLLDDPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLGRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPVILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 8413 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcgggccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagccgggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcattattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8414 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRRAVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREPGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 8415 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatacctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtatctgtggccagaaatcgaacgcctgctgtttggccgcgaaccaggtccggatattcgtggtgttctcgaagatcgccagaaaccggttattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8416 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADARTYFSYARTEERFSYLWPEIERLLFGREPGPDIRGVLEDRQKPVILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 8417 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatacctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcgggccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtatctgtggccagaaatcgaacgcctgctgtttggccgcgaaccaggtccggatattcgtggtgttctcgaagatcgccagaaaccggttattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcattattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8418 - protein, 793 aa, Artificial Sequence
  "Variant of ADP-beta-1,3-glucosyltransferase"
MIEELRQQLLDDPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRRAVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSYLWPEIERLLFGREPGPDIRGVLEDRQKPVILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 8419 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8420 - protein, 793 aa, Artificial Sequence
  "Variant of ADP-beta-1,3-glucosyltransferase"
MIEELRQQLLDDPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 8421 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagccgggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8422 - protein, 793 aa, Artificial Sequence
  "Variant of ADP-beta-1,3-glucosyltransferase"
MIEELRQQLLDDPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREPGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 8423 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagattggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgattattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcactattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8424 - protein, 793 aa, Artificial Sequence
  "Variant of ADP-beta-1,3-glucosyltransferase"
MIEELRQQLLDDPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREIGQYESHQDYTLPGLYRVENGIDVFDSKFNIVSPGADARTYFSYARTEERFSSLWPEIESLLFGREPGPDIRGVLEDRQKPIILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 8425 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatacctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctgggtcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcattattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8426 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLGRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME

SEQ ID NO: 8427 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccggttattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggataggcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttcggtcacgcgaatcacaggtcatggaacgctatctgcaaatgttccgccacctgcaatggcgcccgctggctcatgccgtaccgatggag

SEQ ID NO: 8428 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPVILSMARMDRIKNLSGLAELYGRSSRLRSLANLVIIGGHVDVGNSMDAEEREEIRRMHEIMDHYQLDGQLRWVGSQLDKTVAGELYRVVADRRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVRSRESQVMERYLQMFRHLQWRPLAHAVPME

SEQ ID NO: 8429 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagcctgctgtttggccgcgaaccaggtccggatattcgtggtgttctcgaagatcgccagaaaccgctgattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggtcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8430 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 8431 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaagattttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcgggccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctggatcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgagccgggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagtctgctgtttggccgcgaaccaggtccggatattcgtggtgttctcgaagatcgccagaaaccggttattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggatggacgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgaagtattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8432 - protein, 793 aa, Artificial Sequence
  "Variant of ADP-beta-1,3-glucosyltransferase"
MIEELRQQLLDDPRSWRAFLRHLVASQRDSWLHTDLQRACKDFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRRAVQYLGTLPRETPWAEFREDMRRRGFEPGWGNTAGRVRETMRLLMDLLDSPSPAALESFLDRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREPGQYESHQDYTLPGLYRVENGIDVFDSKFNIVSPGADARTYFSYARTEERFSSLWPEIESLLFGREPGPDIRGVLEDRQKPVILSMARMDRIKNLSGLAELYGRSSRLRSLANLVIIGGHVDVGNSMDAEEREEIRRMHEIMDHYQLDGQLRWVGSQLDKTVAGELYRVVADGRGVFVQPALFEAFGLTVIEAMSSGLPVFATRHGGPLEIIEDGVSGFHIDPNDPEATAEKLADFLEAARERPKYWEEISDAALARVSERYTWERYAERLMTIARVFGFWRFVLSRESQVMERYLQMFRHLQWRPLAHAVPME

SEQ ID NO: 8433 - DNA, 2379 bp, Artificial Sequence
  "Variant of ADP-beta-1,3-glucosyltransferase"
atgattgaagaactgcgccaacagctgctggatgatccgcgttcatggcgtgcattcctgcgtcatttagtcgcatctcagcgtgactcatggttacatacggatttacagcgcgcgtgcaaaacgtttcgcgaacagcctccggaaggctatcccgaagatattggttggctggcagattttgtggcacatacccaggaagcgatcttccgggatccgtggatggtttttgcgtggcgtctacgtccaggtgtttgggagtatgtgcgcatacatgtagaacagctggcggtggaggagctgagcactgatgaatatctgcaagccaaagaacaacttgttggcttaggtgcagaaggtgaagctgttctgacggtggatttcgaagattttcgtccggtgagccgtcgtttacgcgacgagagcaccattggtgatggtcttacccatctgaatcgtcatttagcaggtcgcatctggactgatttagcagcaggtcgtagtcagattctggaatttctgggcctgcatcgtctggataaccagaatctgatgctgagcaacggcaataccgattttgactctttacgtcaaaccgtacaatatctgggcaccttaccacgtgaaactccgtgggcagagtttcgtgaagacatgcgtcgtcgtggttttgaacccggttggggcaacaccgcgggccgtgttcgcgaaaccatgcgtctgctgatggatctgcttgactctccgagcccagctgccctggagagcttcctgggtcgcatcccgatgattagcaacgttctgatcgtgagcattcacggatggtttgcgcaggacaaggttctgggtcgtccggacactggtggtcaggtcgtgtatattctggatcaggcccgtgcactggaacgcgaaatgcgtaaccgcctgcgccaacagggtgttgatgtggagccgcgcattttgattgcgacccgtttaatcccggaaagtgatggcacgacttgtgaccagcgtctggagcctgtccatggtgccgagaatgtgcagattctgcgcgttccgtttcgctatgaggatggtcgtattcacccgcattggatctcacgcttcaaggtttggccgtatcttgaacgctatgcatcagatctggaacgcgaagttaaggccgaattaggtagtcgtccagatctgatcatcggcaactatagcgacggtaatctggttgcaaccctgctgtcagaaaaattaggtgttacgcagtgcaacattgcacatgccctggagaaaagcaagtacctgtattccgatctgcattggccggatcacgaacaggaccatcactttgcgtgtcagtttaccgcggatctgatcgcgatgaatgcagcagacatcatcgtgacgagcacataccaggaaattgcaggtaatgaccgcgaggttggtcaatatgaatctcaccaggactatactttaccgggcttgtatcgtgtcgagaatggtattgacgtgttcgatagcaagtttaacattgtgagtccgggcgcagatgcgcgcacgtattttagctatgcccgtactgaagaacgcttctcgtctctgtggccagaaatcgaaagcctgctgtttggccgcgaaccaggtccggatattcgtggtgttctcgaagatcgccagaaaccgcttattctgtcgatggcccgtatggatcgcatcaagaacctgagcggtctggccgaactgtatggtcggagttctcgcttacgtagcctggccaatttggtgatcatcggtggtcatgttgatgtggggaatagtatggatgcagaagaacgcgaagaaatccgtcgtatgcacgagatcatggaccattaccagctggatggtcagctgcgttgggtgggatcgcagctggataaaaccgtcgcgggcgaattgtatcgtgtagtggcggataagcgtggcgtttttgtgcaaccagccctgtttgaggcgttcggcctgaccgtgattgaggcaatgagcagtggcctgccagtgtttgcgacccgccacggtggtccgctggaaatcatcgaagacggcgttagcggcttccatattgatcccaacgaccctgaagcgaccgcagaaaaactggccgacttcctggaagcagcgcgtgaacgtccgcattattgggaggaaattagcgatgcggctcttgcgcgcgtcagcgaacgttacacgtgggagcgctatgcggaacgcttgatgaccatcgcgcgtgttttcggcttttggcgcttcgttctgtcacgcgaatcacaggtcatggaacgctatctgcaaatgttccgccacctgcaatggcgcccgctggctcatgccgtaccgatggag

SEQ ID NO: 8434 - protein, 793 aa, Artificial Sequence
  "Variant of ADP-beta-1,3-glucosyltransferase"
MIEELRQQLLDDPRSWRAFLRHLVASQRDSWLHTDLQRACKTFREQPPEGYPEDIGWLADFVAHTQEAIFRDPWMVFAWRLRPGVWEYVRIHVEQLAVEELSTDEYLQAKEQLVGLGAEGEAVLTVDFEDFRPVSRRLRDESTIGDGLTHLNRHLAGRIWTDLAAGRSQILEFLGLHRLDNQNLMLSNGNTDFDSLRQTVQYLGTLPRETPWAEFREDMRRRGFEPGWGNTAGRVRETMRLLMDLLDSPSPAALESFLGRIPMISNVLIVSIHGWFAQDKVLGRPDTGGQVVYILDQARALEREMRNRLRQQGVDVEPRILIATRLIPESDGTTCDQRLEPVHGAENVQILRVPFRYEDGRIHPHWISRFKVWPYLERYASDLEREVKAELGSRPDLIIGNYSDGNLVATLLSEKLGVTQCNIAHALEKSKYLYSDLHWPDHEQDHHFACQFTADLIAMNAADIIVTSTYQEIAGNDREVGQYESHQDYTLPGLYRVENGIDVFDSKFNIVSPGADARTYFSYARTEERFSSLWPEIESLLFGREPGPDIRGVLEDRQKPLILSMARMDRIKNLSGLAELYGRSSRLRSLANLVIIGGHVDVGNSMDAEEREEIRRMHEIMDHYQLDGQLRWVGSQLDKTVAGELYRVVADKRGVFVQPALFEAFGLTVIEAMSSGLPVFATRHGGPLEIIEDGVSGFHIDPNDPEATAEKLADFLEAARERPHYWEEISDAALARVSERYTWERYAERLMTIARVFGFWRFVLSRESQVMERYLQMFRHLQWRPLAHAVPME
